US012616207B2

(12) United States Patent
Kong

(10) Patent No.: US 12,616,207 B2
(45) Date of Patent: May 5, 2026

(54) **BOXWOOD ENDOPHYTE *BURKHOLDERIA* SP SSG AS POTENTIAL BIOCONTROL AGENT AGAINST A WIDE RANGE OF PATHOGENS**

(71) Applicant: VIRGINIA TECH INTELLECTUAL PROPERTIES, INC., Blacksburg, VA (US)

(72) Inventor: Ping Kong, Virginia Beach, VA (US)

(73) Assignee: VIRGINIA TECH INTELLECTUAL PROPERTIES, INC., Blacksburg, VA (US)

( * ) Notice: Subject to any disclaimer, the term of this patent is extended or adjusted under 35 U.S.C. 154(b) by 625 days.

(21) Appl. No.: 17/905,283

(22) PCT Filed: Mar. 3, 2021

(86) PCT No.: PCT/US2021/020606
§ 371 (c)(1),
(2) Date: Aug. 30, 2022

(87) PCT Pub. No.: WO2021/178496
PCT Pub. Date: Sep. 10, 2021

(65) Prior Publication Data
US 2023/0225329 A1      Jul. 20, 2023

Related U.S. Application Data

(60) Provisional application No. 63/010,644, filed on Apr. 15, 2020, provisional application No. 62/985,165, filed on Mar. 4, 2020.

(51) Int. Cl.
*A01N 63/20*     (2020.01)
*A01P 3/00*      (2006.01)
*C12N 1/20*      (2026.01)

(52) U.S. Cl.
CPC ................ *A01N 63/20* (2020.01); *A01P 3/00* (2021.08); *C12N 1/20* (2013.01)

(58) Field of Classification Search
CPC .............. A01N 63/20; A01P 3/00; C12N 1/20
See application file for complete search history.

(56) References Cited

U.S. PATENT DOCUMENTS 6,524,998 B1     2/2003   Kloepper et al.
2004/0127687 A1  7/2004   Casida, Jr. et al.
(Continued)

OTHER PUBLICATIONS

NCBI Blast. SEQ ID No. 3 and ATCC 25416 Sequence Alignment. (Year: 2025).*

(Continued)

*Primary Examiner* — Jennifer A Berrios
*Assistant Examiner* — Chasity P Janosko
(74) *Attorney, Agent, or Firm* — Thomas | Horstemeyer, LLP

(57)     ABSTRACT

The disclosure, in one aspect, relates to compositions containing non-pathogenic *Burkholderia* species SSG and/or extracts from SSG cultures and methods of making and using the same. Also disclosed are methods for treating and preventing plant diseases caused by pathogens, the methods including applying the disclosed compositions to plants and/or soil, diseased leaf debris, or other plant growth media surrounding the plants. Finally, disclosed are methods for increasing plant growth using the disclosed compositions. The compositions are effective as well as environmentally benign and are not detrimental to human or animal health This abstract is intended as a scanning tool for purposes of searching in the particular art and is not intended to be limiting of the present disclosure.

18 Claims, 19 Drawing Sheets
Specification includes a Sequence Listing.

(56)                        References Cited

U.S. PATENT DOCUMENTS

| 2016/0100587 | A1 | 4/2016 | Bywater-Ekegard et al. |
| 2018/0170819 | A1 | 6/2018 | West et al. |
| 2019/0021337 | A1 | 1/2019 | Von Maltzahn et al. |

OTHER PUBLICATIONS

Kong, P., Evaluation of a novel endophytic Pseudomonas lactis strain for control of boxwood blight. J. Environ. Hort. 37(2), 39-43 (Year: 2019).*
Daligaul T et al. "Whole-Genome Assemblies of 56 *Burkholderia* Species," Genome Announcements, Nov. 20, 2014 (Nov. 20, 2014), vol. 2, No. 6: e01106-14, pp. 1-3. entire document.
International Search Report and Written Opinion for PCT/US2021/020606 mailed Aug. 6, 2021.

* cited by examiner

120

Boxwood cultivar & treatment

BOXWOOD ENDOPHYTE *BURKHOLDERIA* SP SSG AS POTENTIAL BIOCONTROL AGENT AGAINST A WIDE RANGE OF PATHOGENS

CROSS REFERENCE TO RELATED APPLICATIONS

This application is a U.S. national phase application under 35 U.S.C. 371 of International Patent Application No. PCT/US2021/020606, filed Mar. 3, 2021, which claims priority upon U.S. Provisional Application No. 62/985,165, filed on Mar. 4, 2020, and U.S. Provisional Application No. 63/010,644, filed on Apr. 15, 2020.

STATEMENT REGARDING FEDERALLY SPONSORED RESEARCH OR DEVELOPMENT

This invention was made with U.S. Government support under grant numbers 16-8130-0202-CA and 17-8130-0282-CA, and by Specialty Crop Block Grant for Virginia (FFY 2018-586, 301-190934), all awarded by the U.S. Department of Agriculture. The U.S. government has certain rights in the invention.

CROSS REFERENCE TO SEQUENCE LISTING

The genetic components described herein are referred to by sequence identifier numbers (SEQ ID NO). The SEQ ID NOs correspond numerically to the sequence identifiers <400>1, <400>2, etc. The sequence listing in written computer readable format (CRF) as a text file named "222204-1875_Replacement_Sequence_Listing_ST25.txt" created on Jan. 30, 2023 and updated on Mar. 6, 2023, and having a size of 11,144,438 bytes, is incorporated by reference in its entirety.

BACKGROUND

Boxwood (*Buxus*) is a genus of about 70 species in the family Buxaceae. As slow-growing evergreen shrubs and small trees, they are planted worldwide, especially in landscapes and gardens. Boxwood blight is a destructive disease caused by *Calonectria pseudonaviculata* (Cps). In the United States, the disease was first observed and confirmed in North Carolina and Connecticut in 2011 and it has been reported in 30 states as of February 2021. English boxwood (*Buxus sempervirens* 'Suffruticosa'), an iconic plant in American and European landscapes including many historic gardens and plantings, is highly susceptible to this disease. Currently, boxwood protection relies largely on repeated fungicide applications because there are essentially no cultivars that are immune to Cps and eradication of seriously diseased plants results in significant economic loss to the growers and owners. Furthermore, replacing English boxwood in the gardens of royal and historical estates with less susceptible varieties or cultivars is affected by the plants' market and historic values. Cps also attacks several *pachysandra*, sweet box, and potentially some common groundcovers and boxwood companion plants outside of the Buxaceae family.

While chemical control is effective, it is also expensive and potentially a threat to human health and to the environment. Specifically, chlorothalonil, one of the most effective compounds for controlling Cps, has recently been classified as a category one carcinogen and removed from the market in Europe. In addition, the use of fungicides in historic gardens and residential and commercial landscapes is particularly challenging. Economically viable and environmentally sound disease control methods are urgently needed.

Recent studies on mulching and biological control alternatives provided safer and more sustainable management of boxwood blight. Mulching over the infested soil and diseased leaf litter protect plants by effectively preventing pathogen inoculum from splashing onto healthy boxwood foliage. However, this method is powerless to avert transmission above the ground. Two recently identified Cps antagonists, *Trichoderma koningiopsis* from wild mushrooms and *Pseudomonas protegens* from plant nursery recycled irrigation water, have shown potential to be used to reduce disease by about 60%. However, ornamental plants at such protection levels are not marketable.

Plant diseases, including but not limited to boxwood blight, can wipe out entire crops and historical plantings in a short period of time. Globally, plant diseases pose an increasing risk to food security and plant biosecurity. The current approach to disease management depends mainly on chemical protection. This approach is not sustainable due to growing costs, fungicide resistance risk, and human and environmental safety concerns. Managing plant diseases in the environmental horticulture industry is particularly challenging as this industry produces a live commodity that requires the highest level of plant health for aesthetic value. More importantly, this commodity is expected to survive the stresses of shipment, retail, and being planted, then become established at its final destination. Contaminated plants at production facilities may appear healthy without any disease symptoms under intensive chemical protection programs. However, plants may become diseased when they reach their final destinations due to severe stress during shipment, sale, and field establishment, or from lack of continuing chemical protection. There is an urgent need to build a long-term disease-fighting mechanism into horticultural crop products to sustainably safeguard plants.

Endophytes are the microorganisms that reside within the host plant's tissues in a commensal or beneficial manner. Endophytes have received considerable attention for their potential as ideal biocontrol agents because of their ability to suppress plant pathogens and to promote plant growth and yield. Many endophytes that also act as biocontrol agents for plant diseases are also plant growth promoters.

Despite advancements in Cps control research, there is still a lack of biological control agents that are potent, effective, inexpensive, and safe for controlling boxwood blight and other plant diseases caused by bacteria, fungi, viruses, and oomycetes. It would be desirable if the agents were effective both as preventive measures and as post-exposure treatments, were non-pathogenic towards humans, and contributed to increased plant growth. It would further be desirable if the agents served as broad-spectrum biological control strains and additionally acted as a bio-sanitizer as well as a bio-fertilizer enhancing boxwood plant growth. These needs and other needs are satisfied by the present disclosure.

SUMMARY

In accordance with the purpose(s) of the present disclosure, as embodied and broadly described herein, the disclosure, in one aspect, relates to compositions containing non-pathogenic *Burkholderia* species SSG and/or extracts from SSG cultures and methods of making and using the same. Also disclosed are methods for treating and preventing plant diseases caused by pathogens, the methods including applying the disclosed compositions to plants and/or soil, diseased leaf debris, or other plant growth media surrounding the plants. Finally, disclosed are methods for increasing plant growth using the disclosed compositions. The compositions are effective as well as environmentally benign and are not detrimental to human or animal health.

Other systems, methods, features, and advantages of the present disclosure will be or become apparent to one with skill in the art upon examination of the following drawings and detailed description. It is intended that all such additional systems, methods, features, and advantages be included within this description, be within the scope of the present disclosure, and be protected by the accompanying claims. In addition, all optional and preferred features and modifications of the described embodiments are usable in all aspects of the disclosure taught herein. Furthermore, the individual features of the dependent claims, as well as all optional and preferred features and modifications of the described embodiments are combinable and interchangeable with one another.

BRIEF DESCRIPTION OF THE DRAWINGS

Many aspects of the present disclosure can be better understood with reference to the following drawings. The components in the drawings are not necessarily to scale, emphasis instead being placed upon clearly illustrating the principles of the present disclosure. Moreover, in the drawings, like reference numerals designate corresponding parts throughout the several views.

FIG. 3A. Disease incidence at 50 day after treatment. Each column depicts 18 pot plants from 3 experiments. Bar on the top is the standard error. FIG. 3B. Image of representative pots from treatments at 50 dat. FIG. 3C. Leaves on a branch of the treatment at 50 day after treatment. Each column depicts 12 pot plants from 3 experiments.

FIG. 6A annual *vinca* and *P. nicotianae*. FIG. 6B *rhododendron* and *P. ramorum*. FIG. 6C pepper and *P. capsica*. FIG. 6D tomato and *P. infestans*.

FIG. 7A. Volutella blight on boxwood Green velvet. FIG. 7B. Gray mold on *petunia*. FIG. 7C. Bacterial blight on geranium. FIG. 7D. Tomato spotted wilt virus on *impatiens*.

(FIG. 17A) Color produced at 2 days showing IAA production; (FIG. 17C) Growth on nitrogen free media at 4 days showing nitrogen fixation; (FIG. 17E) Halo produced around disks at 7 days showing phosphate solubilization and (FIG. 17G) Color change at 3 days showing siderophore production. FIGS. 17B, 17D, 17F, and 17H are images of the control tube or plate for FIGS. 17A, 17C, 17E, and 17G, respectively.

Figure 1:
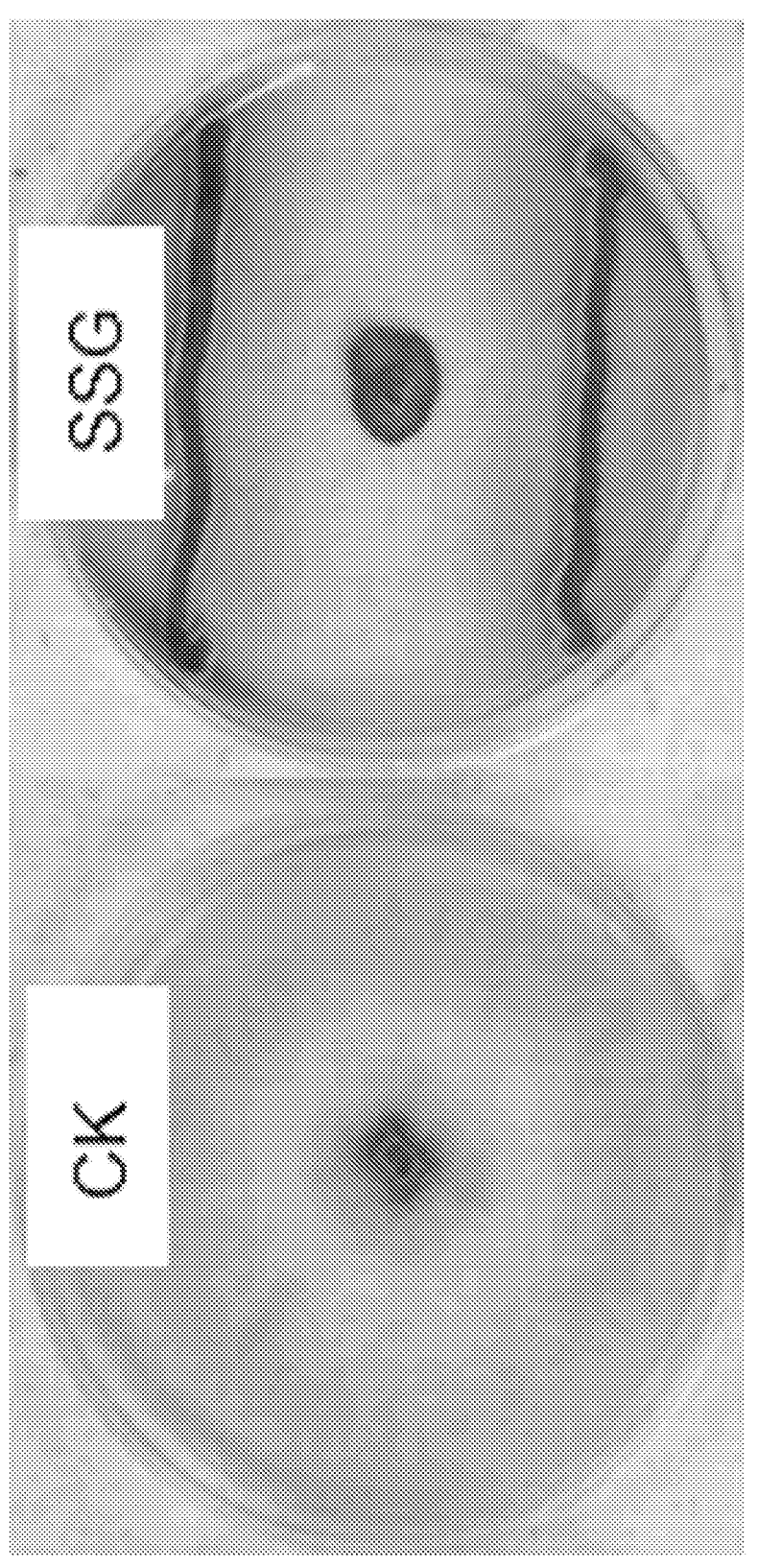
FIG. 1 is a photograph comparing growth of Cps on PDA at 28 days of the assay with nutrient broth (CK) and SSG from boxwood, showing the effects of SSG on *Calonectria pseudonaviculata* (Cps).

Additional advantages of the invention will be set forth in part in the description which follows, and in part will be obvious from the description, or can be learned by practice of the invention. The advantages of the invention will be realized and attained by means of the elements and combinations particularly pointed out in the appended claims. It is to be understood that both the foregoing general description and the following detailed description are exemplary and explanatory only and are not restrictive of the invention, as claimed.

DETAILED DESCRIPTION

Disclosed herein are compositions and methods for treating or preventing a plant disease caused by a bacterial, fungal, or *Phytophthora* pathogen, the methods including applying to a plant, a plant growing medium, or diseased leaf debris an effective amount of a composition, wherein the composition includes a microbial strain comprising a DNA sequence exhibiting at least 85% sequence identity to at least one of SEQ ID NOs. 1-6, an extract produced by culturing the microbial strain, or any combination thereof. In a further aspect, the microbial strain can be *Burkholderia cepacia* complex (Bcc) strain SSG.

Also disclosed are compositions methods for increasing plant growth, the methods including applying to a plant or to a plant growing medium an effective amount of a composition, wherein the composition includes a microbial strain comprising a DNA sequence exhibiting at least 85% sequence identity to at least one of SEQ ID NOs. 1-6, an extract produced by culturing the microbial strain, or any combination thereof, so that a treated plant has increased growth compared to an untreated plant. In a further aspect, the microbial strain can be *Burkholderia cepacia* complex (Bcc) strain SSG.

Many modifications and other embodiments disclosed herein will come to mind to one skilled in the art to which the disclosed compositions and methods pertain having the benefit of the teachings presented in the foregoing descriptions and the associated drawings. Therefore, it is to be understood that the disclosures are not to be limited to the specific embodiments disclosed and that modifications and other embodiments are intended to be included within the scope of the appended claims. The skilled artisan will recognize many variants and adaptations of the aspects described herein. These variants and adaptations are intended to be included in the teachings of this disclosure and to be encompassed by the claims herein.

Although specific terms are employed herein, they are used in a generic and descriptive sense only and not for purposes of limitation.

As will be apparent to those of skill in the art upon reading this disclosure, each of the individual embodiments described and illustrated herein has discrete components and features which may be readily separated from or combined with the features of any of the other several embodiments without departing from the scope or spirit of the present disclosure.

Any recited method can be carried out in the order of events recited or in any other order that is logically possible. That is, unless otherwise expressly stated, it is in no way intended that any method or aspect set forth herein be construed as requiring that its steps be performed in a specific order. Accordingly, where a method claim does not specifically state in the claims or descriptions that the steps are to be limited to a specific order, it is no way intended that an order be inferred, in any respect. This holds for any possible non-express basis for interpretation, including matters of logic with respect to arrangement of steps or operational flow, plain meaning derived from grammatical organization or punctuation, or the number or type of aspects described in the specification.

All publications mentioned herein are incorporated herein by reference to disclose and describe the methods and/or materials in connection with which the publications are cited. The publications discussed herein are provided solely for their disclosure prior to the filing date of the present application. Nothing herein is to be construed as an admission that the present invention is not entitled to antedate such publication by virtue of prior invention. Further, the dates of publication provided herein can be different from the actual publication dates, which can require independent confirmation.

While aspects of the present disclosure can be described and claimed in a particular statutory class, such as the system statutory class, this is for convenience only and one of skill in the art will understand that each aspect of the present disclosure can be described and claimed in any statutory class.

It is also to be understood that the terminology used herein is for the purpose of describing particular aspects only and is not intended to be limiting. Unless defined otherwise, all technical and scientific terms used herein have the same meaning as commonly understood by one of ordinary skill in the art to which the disclosed compositions and methods belong. It will be further understood that terms, such as those defined in commonly used dictionaries, should be interpreted as having a meaning that is consistent with their meaning in the context of the specification and relevant art and should not be interpreted in an idealized or overly formal sense unless expressly defined herein.

Prior to describing the various aspects of the present disclosure, the following definitions are provided and should be used unless otherwise indicated. Additional terms may be defined elsewhere in the present disclosure.

Definitions

As used herein, "comprising" is to be interpreted as specifying the presence of the stated features, integers, steps, or components as referred to, but does not preclude the presence or addition of one or more features, integers, steps, or components, or groups thereof. Moreover, each of the terms "by", "comprising," "comprises", "comprised of," "including," "includes," "included," "involving," "involves," "involved," and "such as" are used in their open, non-limiting sense and may be used interchangeably. Further, the term "comprising" is intended to include examples and aspects encompassed by the terms "consisting essentially of" and "consisting of." Similarly, the term "consisting essentially of" is intended to include examples encompassed by the term "consisting of.

As used in the specification and the appended claims, the singular forms "a," "an" and "the" include plural referents unless the context clearly dictates otherwise. Thus, for example, reference to "a plant," "a leaf," or "an excipient," includes, but is not limited to, collections, mixtures, or combinations of two or more such plants, leaves, or excipients, and the like.

It should be noted that ratios, concentrations, amounts, and other numerical data can be expressed herein in a range format. It will be further understood that the endpoints of each of the ranges are significant both in relation to the other endpoint, and independently of the other endpoint. It is also understood that there are a number of values disclosed herein, and that each value is also herein disclosed as "about" that particular value in addition to the value itself. For example, if the value "10" is disclosed, then "about 10" is also disclosed. Ranges can be expressed herein as from "about" one particular value, and/or to "about" another particular value. Similarly, when values are expressed as approximations, by use of the antecedent "about," it will be understood that the particular value forms a further aspect. For example, if the value "about 10" is disclosed, then "10" is also disclosed.

When a range is expressed, a further aspect includes from the one particular value and/or to the other particular value. For example, where the stated range includes one or both of the limits, ranges excluding either or both of those included limits are also included in the disclosure, e.g. the phrase "x to y" includes the range from 'x' to 'y' as well as the range greater than 'x' and less than 'y'. The range can also be expressed as an upper limit, e.g. 'about x, y, z, or less' and should be interpreted to include the specific ranges of 'about x', 'about y', and 'about z' as well as the ranges of 'less than x', less than y', and 'less than z'. Likewise, the phrase 'about x, y, z, or greater' should be interpreted to include the specific ranges of 'about x', 'about y', and 'about z' as well as the ranges of 'greater than x', greater than y', and 'greater than z'. In addition, the phrase "about 'x' to 'y'", where 'x' and 'y' are numerical values, includes "about 'x' to about 'y'".

It is to be understood that such a range format is used for convenience and brevity, and thus, should be interpreted in a flexible manner to include not only the numerical values explicitly recited as the limits of the range, but also to include all the individual numerical values or sub-ranges encompassed within that range as if each numerical value and sub-range is explicitly recited. To illustrate, a numerical range of "about 0.1% to 5%" should be interpreted to include not only the explicitly recited values of about 0.1% to about 5%, but also include individual values (e.g., about 1%, about 2%, about 3%, and about 4%) and the sub-ranges (e.g., about 0.5% to about 1.1%; about 5% to about 2.4%; about 0.5% to about 3.2%, and about 0.5% to about 4.4%, and other possible sub-ranges) within the indicated range.

As used herein, the terms "about," "approximate," "at or about," and "substantially" mean that the amount or value in question can be the exact value or a value that provides equivalent results or effects as recited in the claims or taught herein. That is, it is understood that amounts, sizes, formulations, parameters, and other quantities and characteristics are not and need not be exact, but may be approximate and/or larger or smaller, as desired, reflecting tolerances, conversion factors, rounding off, measurement error and the like, and other factors known to those of skill in the art such that equivalent results or effects are obtained. In some circumstances, the value that provides equivalent results or effects cannot be reasonably determined. In such cases, it is generally understood, as used herein, that "about" and "at or about" mean the nominal value indicated ±10% variation unless otherwise indicated or inferred. In general, an amount, size, formulation, parameter or other quantity or characteristic is "about," "approximate," or "at or about" whether or not expressly stated to be such. It is understood that where "about," "approximate," or "at or about" is used before a quantitative value, the parameter also includes the specific quantitative value itself, unless specifically stated otherwise.

As used herein, the term "effective amount" refers to an amount that is sufficient to achieve the desired modification of a physical property of the composition or material. For example, an "effective amount" of an active ingredient refers to an amount that is sufficient to achieve the desired improvement in the property modulated by the formulation component, e.g. achieving the desired level of pathogen and/or disease control. The specific level in terms of wt % in a composition required as an effective amount will depend upon a variety of factors including the amount and type of *Burkholderia* metabolites in the composition and/or presence of live cells, amount and type of any carriers or excipients, conditions surrounding the plants to be treated, length of time since treatment and/or number of treatments to be applied, degree of infestation, and identity of the pathogen to be treated.

As used herein, the terms "optional" or "optionally" means that the subsequently described event or circumstance can or cannot occur, and that the description includes instances where said event or circumstance occurs and instances where it does not.

"Inoculum" as used herein refers to a composition containing microorganisms, wherein the composition used to pretreat a plant for the purpose of establishing a population of the microorganisms on the plant. A successful inoculum can be at an active growth stage and size and will generally be free from contamination and may include additional components useful for establishing a population of microorganisms such as, for example, culture medium, solvents, buffers, and the like. In some aspects, a Cps fungal inoculum is prepared to infect plants in order to assess the efficacy of disclosed treatments. In other aspects, an SSG inoculum can be used to treat plants suffering from boxwood blight.

"Colony forming units" (CFU) refers to an estimate of the number of viable microorganisms (e.g., bacteria or fungi) in a sample. In one aspect, number of CFU in a sample can be established by culturing the sample on a plate and counting microbial colonies, wherein each colony is assumed to have arisen from a single cell or group of cells.

As used herein, "conidium" refers to an asexual, non-motile fungal spore. In one aspect, conidia are important reproductive features for Cps. In another aspect, application of the compositions and extracts disclosed herein can interfere with conidium formation and/or germination, or can cause lysis of Cps conidia.

"Microsclerotia" as used herein are resting structures of a fungus such as, for example, Cps. A "*sclerotium*" is a had mass of fungal mycelium that contains some amount of nutritional reserve high in oils and low in moisture and that can survive environmental extremes; a "microsclerotium" is so defined based on relative size.

"Mycelium" as used herein refers to a vegetative body of a fungus composed of branching fungal "hyphae." The hyphae secrete enzymes that can break down biopolymers, the decomposition products of which are then absorbed by the mycelium and used as nutrients.

"Zoospores" are asexual, motile propagules of oomycetes such as *Phytophthora* and *Pythium* species. A zoospore uses a flagellum for locomotion and can additionally be transmitted to uninfected plants by wind, water, and the like. "Sporulation" refers to the formation of spores from vegetative cells during adverse environmental conditions.

"Boxwood blight" refers to a fungal disease of boxwood plants (i.e. *Buxus* species, varieties, and cultivars). Boxwood blight is caused by *Calonectria pseudonaviculata* (Cps), which is also sometimes called *Cylindrocladium buxicola*. *Buxus sempervirens* varieties may be more susceptible to boxwood blight but related species of *Pachysandra* and *Sarcococca* are also susceptible. Boxwood blight is initially found as spots or lesions on leaves, progressing to browning of leaves, which then fall off. Cps zoospores can remain viable for several years in fallen boxwood leaves and can be dispersed by wind, rain, contaminated clothing, animals, and the like. Disclosed herein are methods and compositions for treating and preventing boxwood blight and other diseases caused by plant pathogens.

As used herein, "cell suspension" refers to compositions including un-lysed *Burkholderia cepacia* SSG cells, while "cell free supernatant" refers to solutions produced by centrifugation of an SSG culture suspension followed by filtration of the supernatant to remove any remaining cells.

"Genomovar" as used herein refers to a *Burkholderia* strain that is phenotypically indistinguishable from related *Burkholderia* strains but that can be classified as a species based on DNA sequencing or other biochemical testing.

"Phytopathosystem" refers to a combination of a plant and pathogen. In one aspect, a *Buxus sempervirens* plant infected with Cps is an example of a phytopathosystem.

As used herein, the terms "treating" and "treatment" can refer generally to obtaining a desired physiological effect in a diseased plant. The effect can be, but does not necessarily have to be, prophylactic in terms of preventing or partially preventing a disease, symptom, or condition thereof. The effect can be therapeutic in terms of a partial or complete cure of a disease, condition, symptom or adverse effect attributed to the disease, disorder, or condition. The term "treatment" as used herein can include any treatment of a fungal, bacterial, and/or oomycete infection in a plant, and can include any one or more of the following: (a) preventing the disease from occurring in a plant which may have been exposed to an infected plant; (b) inhibiting the disease, i.e., arresting its development; and (c) relieving the disease, i.e., mitigating or ameliorating the disease and/or its symptoms or conditions. The term "treatment" as used herein can refer to both therapeutic treatment alone, prophylactic treatment alone, or both therapeutic and prophylactic treatment. Plants in need of treatment can include those already with the disorder and/or those in which the disorder is to be prevented. As used herein, the term "treating", can include inhibiting the disease, disorder or condition, e.g., impeding its progress; and relieving the disease, disorder, or condition, e.g., causing regression of the disease, disorder, and/or condition. Treating the disease, disorder, or condition can include ameliorating at least one symptom of the particular disease, disorder, or condition, even if the underlying pathophysiology is not affected.

As used herein, the term "prevent" or "preventing" refers to precluding, averting, obviating, forestalling, stopping, or hindering a plant disease from infecting a plant or spreading among a plant population, especially by advance action. It is understood that where reduce, inhibit or prevent are used herein, unless specifically indicated otherwise, the use of the other two words is also expressly disclosed. In one aspect, prevention of the plant disease is associated with reduced transmission of the plant disease, either by (i) stopping the spread of the disease from one part of a plant to the rest of the plant or (ii) stopping the spread of the disease from one plant to a nearby plant. Reduced transmission and prevention can be assessed quantitatively based on knowledge in the art such as plant growth habit, conditions for disease spread in a given installation type, and the like, wherein reduced transmission or prevention results in a lower amount of spread of a disease than would ordinarily be expected.

As used herein, "increase" or "increasing" refers to making something greater in size, amount, length, or the like. Thus, in one aspect, a treatment that increases plant growth leads to an improvement in at least one growth-related quality of the plant compared to an untreated plant (e.g., the plant with increased growth is larger in size, has greater foliage area, produces more fruits, or has a longer lifetime than an untreated counterpart).

Unless otherwise specified, temperatures referred to herein are based on atmospheric pressure (i.e. one atmosphere).

Microbial Compositions and Extracts

In one aspect, disclosed herein are compositions including a microbial strain that has a DNA sequence exhibiting from about 85% to about 100% sequence identity to at least one of SEQ ID NOs. 1-6, or at least 85, 86, 87, 88, 89, 90, 91, 92, 93, 94, 95, 96, 97, 98, 99, 99.5, or 100% sequence identity to at least one of SEQ ID NOs. 1-6, or a combination of any of the foregoing values, or a range encompassing any of the foregoing values. In one aspect, SEQ ID NOs. 1-6 represent contigs of the genome sequence of SSG. Further in this aspect, SEQ ID NOs. 1-6 can be assembled in a sequential order to identify or elucidate one or more portions of the genome of SSG.

In another aspect, the microbial strain can be a *Burkholderia cepacia* complex (Bcc) member. In a further aspect, the Bcc member can be an epidemic strain marker-negative strain (i.e. does not cause negative effects with respect to human health in either healthy or immunocompromised individuals). In some aspects, the Bcc member is referred to herein as SSG.

In another aspect, the microbial strain can be frozen, lyophilized, or present as metabolically active cells. In one aspect, the microbial strain is present in the composition in an amount of from about $10^9$ to about $10^3$ colony forming units (CFU) per mL, or at about $10^9$, $10^8$, $10^7$, $10^6$, $10^5$, $10^4$, or about $10^3$ CFU/mL, or a combination of any of the foregoing values, or a range encompassing any of the foregoing values.

In yet another aspect, disclosed herein are extracts produced by culturing the disclosed microbial strains and/or microbial compositions. In one aspect, the extracts are substantially free of microbial cells. In another aspect, the extracts can be produced by (a) culturing the microbial strain in a culture medium and (b) filtering the culture medium. In one aspect, the culture medium can be filtered with a 0.22 μm filter Excipients, Diluents, Carriers, and Additional Active Ingredients In any of these aspects, the compositions further include at least one excipient, diluent, or carrier, or any combination thereof. In another aspect, the at least one excipient, diluent, or carrier can be a surfactant, a solvent, an emulsifier, a buffer, a cryoprotectant, a salt, microbial culture medium, a wetting agent, a bulking agent, an anti-caking agent, a thickener, a clay, a mineral, a lipid, a gum, a dye or colorant, a biological waste material, or any combination thereof. In some aspects, one compound or component can fit in different categories (e.g., a clay can also act as a thickener and/or a bulking agent, or a salt may also have buffering properties and/or act as a cryoprotectant, and the like).

In one aspect, the cryoprotectant can be ethylene glycol, propylene glycol, glycerol, dimethyl sulfoxide, sucrose, trehalose, or any combination thereof.

In one aspect, the clay can be a natural clay, a clay mineral, or a natural or synthetic silicate salt. In a further aspect, the clay can be selected from aluminum magnesium silicate, aluminum potassium sodium silicate, aluminum silicate, aluminum sodium silicate, attapulgite-type clay, bentonite, calcium oxide silicate, calcium silicate, Fuller's earth, kaolin, magnesium oxide silicate, magnesium silicate, magnesium silicate hydrate, montmorillonite, perlite, potassium aluminum silicate, vermiculite, wollastonite, zeolites, or any combination thereof.

In another aspect, the salt can be a salt, buffer, or any combination thereof. In one aspect, the salt can be calcium acetate, calcium citrate, calcium sulfate, citric acid, dipotassium citrate, disodium citrate, disodium sulfate, ferric oxide, ferrous oxide, iron magnesium oxide, magnesium carbonate, magnesium oxide, magnesium sulfate, potassium acetate, potassium bicarbonate, potassium chloride, potassium citrate, potassium sulfate, sodium acetate, sodium bicarbonate, sodium chloride, sodium citrate, sodium sulfate, zinc iron oxide, zinc oxide, zinc stearate, hydrates thereof, conjugate acids and/or bases thereof, and any combination thereof.

In another aspect, the mineral can be calcium carbonate, feldspar, granite, graphite, gypsum, hematite, lime, limestone, mica, mica-group minerals, nepheline syenite, pumice, shale, or any combination thereof.

In one aspect, the lipid can be one or more waxes, one or more acylglycerols, one or more triglycerides, one or more diglycerides, one or more monoglycerides, one or more fatty acids, one or more steroids, or any combination thereof. Examples of useful lipids include, but are not limited to, tristearin, glycerol behenate, glycerol monostearate, stearic acid, cholesterol, cetyl palmitate, and combinations thereof. In another aspect, the lipid can further function as an emulsifier, surfactant, detergent, wetting agent, foaming agent, dispersant, or any combination thereof.

In one aspect, the dye or colorant can be selected from chlorophyll, red cabbage color, ultramarine blue, or any combination thereof.

In another aspect, the thickener can be agar, carrageenan, or any combination thereof. In another aspect, the wax can be beeswax, carnauba wax, paraffin wax, or any combination thereof. In still another aspect, the gum can be locust bean gum, gellan gum, guar gum, gum arabic, gum tragacanth, xanthan gum, or any combination thereof.

In one aspect, the biological waste material can be almond hulls, almond shells, bone meal, bran, bread crumbs, cardboard, cellulose or a chemically-modified cellulose, citrus meal, citrus pulp, clam shells, cocoa, cocoa shell flour, cocoa shells, coffee grounds, cork, corn cobs, cracked wheat, diatomaceous earth, Douglas fir bark, egg shells, fish meal, peanut shells, peat moss, red cedar chips, sawdust, soybean hulls, soybean meal, soybean flour, walnut flour, walnut shells, wheat, or any combination thereof.

In some aspects, the surfactant can be a polysorbate such as, for example, polysorbate 20. In another aspect, the solvent can be water. In one aspect, the at least one excipient, diluent, or carrier can confer increased stability, wettability, dispersibility, or adherence to a substrate relative to a composition lacking the carrier.

In one aspect, the composition can be or include an emulsion, colloid, granule, pellet, powder, spray, suspension, or solution.

In another aspect, the composition can further include at least one additional active ingredient. In a further aspect, the additional active ingredient can be a fertilizer, a pesticide, an herbicide, or any combination thereof.

Method for Treating or Preventing Plant Disease

In one aspect, disclosed herein is a method for treating or preventing a plant disease caused by a pathogen, the method including applying the disclosed compositions to a plant. In another aspect, the composition can be applied from about 2 days to about 30 days prior to exposure to the pathogen, or can be applied 2, 3, 4, 5, 6, 7, 8, 9, 10, 11, 12, 13, 14, 15, 16, 17, 18, 19, 20, 21, 22, 23, 24, 25, 26, 27, 28, 29, or about 30 days prior to exposure to the pathogen, or a combination of any of the foregoing values, or a range encompassing any of the foregoing values. In one aspect, the composition is applied 2, 10, 20, or 30 days prior to exposure to the pathogen. In an alternative aspect, the composition can be applied from about 3 hours to about 48 hours following exposure to the pathogen, or can be applied at 2, 6, 9, 12, 15, 18, 21, 24, 27, 30, 33, 36, 39, 42, 45, or about 48 hours following exposure to the pathogen, or a combination of any of the foregoing values, or a range encompassing any of the foregoing values. In one aspect, the composition is applied 3, 24, or 48 hours after exposure to the pathogen.

In another aspect, applying the composition to a plant about 1 day prior to exposure to or inoculation with a pathogen reduces at least one symptom of a plant disease by about 99%. In another aspect, applying the composition to a plant about 30 days prior to exposure to the pathogen reduces at least one symptom of a disease by from about 30% to about 75%, or by about 30, 35, 40, 45, 50, 55, 60, 65, 70, or about 75%, or a combination of any of the foregoing values, or a range encompassing any of the foregoing values. In some aspects, the at least one symptom can be blight.

In one aspect, disclosed herein is a method for treating or preventing a plant disease caused by a pathogen, the method including applying the disclosed compositions to at least one environmental component of a plant. In another aspect, the environmental component can be leaf debris, soil, the plant's rhizosphere, a potting or bedding material as disclosed herein, or any combination thereof. About 5 days after treatment with the disclosed compositions and/or extracts, primary inocula (e.g., conidia, microsclerotia) can be reduced by at least about 30%. In still another aspect, about 30 days following treatment with the disclosed compositions and/or extracts, primary inocula can be reduced by at least about 75%. In a still further aspect, treatment with the disclosed compositions and/or methods can remain effective for at least 50 days.

In one aspect, the pathogen can be a bacterium, a fungus, or an oomycete. In a further aspect, when the pathogen is a bacterium, the bacterium can include, but is not limited to, *Escherichia coli*, *Erwinia carotovora*, *Pseudomonas syringae*, *Ralstonia solanacearum*, *Stenotrophomonas maltophilia*, or *Xanthomonas campestris*.

In another aspect, when the pathogen is a fungus, the fungus can include, but is not limited to, *Calonectria pseudonaviculata*, *Alternaria* tenuissium, *Botrytis cinerea*, *Collectortrichum acutatum*, Collectortrichum frutticola, Collectortrichum gleosporiodes, Collectortrichum *viniferum*, *Fusarium* proliferaturm, *Fusarium solani*, or *Volutella buxi*.

In still another aspect, when the pathogen is an oomycete, the pathogen can be a *Phytophthora* species such as, for example, P. *capsica*, P. *cinnamomi*, P. *infestans*, P. *nicotianae*, P. *ramorum*, or P. *sojae*.

In one aspect, the plant can be an ornamental plant, a food plant, an energy crop, a fiber crop, a timber crop, or any combination thereof. In still another aspect, the composition can be applied to the roots, leaves, fruits, flowers, stems, or seeds of the plant, or any combination thereof. In an alternative aspect, the composition can be applied to soil, compost, mulch, leaf litter, sawdust, straw, pine straw, wood chips, gravel, plant growing medium, or other material in a bed surrounding the plant.

In one aspect, the plant can be Fraser fir (*Abies fraseri*), petunia (*Petuniaxhybrida*), rhododendron (*Rhododendron catawbiense*), annual *vinca* (*Catharanthus roseus*), bell pepper (*Capsicum annuum*), cucumber (*Cucumis sativus*), tomato (*Solanum lycopersicum*), hydrangea (*Hydrangea* paniculate), pansy (*Viola tricolor* var. *hortensis*), boxwood (*Buxus* semipervirens), geranium (*Pelargonium* spp.), or *impatiens* (*Impatiens walleriana*), or another species, variety, cultivar, or hybrid thereof. In one aspect, the fungus is *Calonectria pseudonaviculata* (Cps) and the plant is boxwood.

In one aspect, performing the method reduces at least one symptom of the plant disease by from at least 50% to 100%, or by at least 50, 55, 60, 65, 70, 75, 80, 85, 90, 95, 99, 99.5, or 100%, or a combination of any of the foregoing values, or a range encompassing any of the foregoing values. In one aspect, performing the method reduces at least one symptom of the plant disease by at least 50, 65, 90, or 99%.

In another aspect, the at least one symptom can be leaf yellowing, leaf loss, wilting, dwarfing or hypoplasia, gall formation, mycelium or mold growth, smuts, rusts, sclerotia, tissue necrosis, cankers, blight, rot, hypertrophy, or any combination thereof.

In one aspect, performing the method reduces transmission of the plant disease by from at least 50% to 100%, or by at least 50, 55, 60, 65, 70, 75, 80, 85, 90, 95, 99, 99.5, or 100%, or a combination of any of the foregoing values, or a range encompassing any of the foregoing values. In one aspect, performing the method reduces transmission of the plant disease by at least 65, 90, or 99%. In a further aspect, rates of transmission of various plant diseases are known or can be estimated by those knowledgeable in the art based on conditions such as, for example, in a nursery or landscape installation when a diseased plant is introduced. Further in this aspect, reduction of transmission can be calculated following application of the compositions and methods disclosed herein by visually inspecting surrounding plants for symptoms of plant disease such as those discussed herein. Rates of transmission among untreated plants can then be compared to rates of transmission among treated plants and a percentage or amount of reduction can be calculated.

In some aspects, the plant pathogen can be a fungus and performing the method lyses at least a portion of fungal conidia, causes defects in formed fungal conidia, suppresses mycelial growth, reduces survival of fungal microsclerotia, reduces sporulation, or any combination thereof.

In one aspect, disclosed herein is a method for treating or preventing a plant disease caused by a pathogen, the method including at least the step of applying to a plant or to a plant growing medium an effective amount of a composition, wherein the composition includes a microbial strain having a DNA sequence exhibiting at least 85% sequence identity to at least one of SEQ ID NOs. 1-6, an extract produced by culturing the microbial strain, or any combination thereof. In a further aspect, the plant disease can be boxwood blight. Also disclosed are plants treated using the disclosed methods. In another aspect, the DNA sequence can have at least 85, 86, 87, 88, 89, 90, 91, 92, 93, 94, 95, 96, 97, 98, 99, 99.5, or 100% sequence identity to at least one of SEQ ID NOs. 1-6, a combination of any of the foregoing values, or a range encompassing any of the foregoing values.

Method for Increasing Plant Growth

In one aspect, disclosed herein is a method for increasing plant growth, the method including applying the disclosed compositions to a plant so that the treated plant has increased growth compared to an untreated plant. In a further aspect, the plant can be an ornamental plant, a food plant, an energy crop, a fiber crop, a timber crop, or any combination thereof. In another aspect, the composition can be applied to the roots, leaves, fruits, flowers, stems, or seeds of the plant, or any combination thereof. In still another aspect, the composition can be applied to soil, compost, mulch, leaf litter, sawdust, straw, pine straw, wood chips, gravel, plant growing medium, or other material in a bed surrounding the plant.

In one aspect, performing the method can deliver an increased amount of an auxin to the treated plant compared to an untreated plant. In one aspect, the auxin can be indole-3-acetic acid (IAA). In another aspect, performing the method increases the amount of nitrogen available to the treated plant compared to an untreated plant. In yet another aspect, performing the method increases the amount of soluble phosphate available to the treated plant compared to an untreated plant. In still another aspect, performing the method increases the concentration of siderophores available to the treated plant compared to an untreated plant.

In one aspect, the plant can be Fraser fir, *petunia, rhododendron*, annual *vinca*, bell pepper, cucumber, tomato, *hydrangea*, pansy, boxwood, geranium, or *impatiens*.

In another aspect, increasing plant growth can result in increased biomass of the treated plant compared to an untreated plant. In another aspect, increasing plant growth can result in increased fruit production of the treated plant compared to an untreated plant. In still another aspect, increasing plant growth can lead to increased production period of the treated plant compared to an untreated plant, or to an increased productive lifespan of the treated plant compared to an untreated plant. In yet another aspect, increasing plant growth can result in an increased foliage area of the treated plant compared to an untreated plant, wherein increased foliage area can include a greater number of leaves, a larger surface area per individual leaf, or any combination thereof. In one aspect, plant growth can be increased by from at least 35% to at least 75% compared to an untreated plant, or by about 35, 40, 45, 50, 55, 60, 65, 70, or about 75% compared to an untreated plant, or a combination of any of the foregoing values, or a range encompassing any of the foregoing values. In one aspect, plant growth increase by about 35%, about 55%, or about 75% compared to an untreated plant.

In still another aspect, disclosed herein is a method for increasing plant growth, the method including the steps of applying to a plant or to a plant growing medium an effective amount of a composition, wherein the composition includes a microbial strain that includes a DNA sequence exhibiting at least 85% sequence identity to at least one of SEQ ID NOs. 1-6, an extract produced by culturing the microbial strain, or any combination thereof, so that a treated plant has increased growth compared to an untreated plant. In another aspect, the DNA sequence can have from about 85% to about 100% sequence identity to at least one of SEQ ID NOs. 1-6, or about 85, 86, 87, 88, 89, 90, 91, 92, 93, 94, 95, 96, 97, 98, 99, 99.5, or about 100% sequence identity, or a combination of any of the foregoing values, or a range encompassing any of the foregoing values. Also disclosed are plants treated by the disclosed methods.

Now having described the aspects of the present disclosure, in general, the following Examples describe some additional aspects of the present disclosure. While aspects of the present disclosure are described in connection with the following examples and the corresponding text and figures, there is no intent to limit aspects of the present disclosure to this description. On the contrary, the intent is to cover all alternatives, modifications, and equivalents included within the spirit and scope of the present disclosure.

Aspects

The present disclosure can be described in accordance with the following numbered Aspects, which should not be confused with the claims.

Aspect 1. A composition comprising a microbial strain comprising a DNA sequence exhibiting at least 85% sequence identity to at least one of SEQ ID NOs. 1-6 and at least one excipient, diluent, or carrier.

Aspect 2. The composition of aspect 1, wherein the DNA sequence exhibits at least 90% sequence identity to at least one of SEQ ID NOs. 1-6.

Aspect 3. The composition of aspect 1, wherein the DNA sequence exhibits at least 95% sequence identity to at least one of SEQ ID NOs. 1-6.

Aspect 4. The composition of aspect 1, wherein the DNA sequence exhibits at least 99% sequence identity to at least one of SEQ ID NOs. 1-6.

Aspect 5. The composition of aspect 1, wherein the DNA sequence exhibits at least 99.5% sequence identity to at least one of SEQ ID NOs. 1-6.

Aspect 6. The composition of any one of aspects 1-5, wherein, in the composition, the microbial strain is frozen, lyophilized, or is present as metabolically active cells.

Aspect 7. The composition of any one of aspects 1-6, wherein, in the composition, the microbial strain is present in an amount of from about $10^9$ to about $10^3$ colony forming units per mL.

Aspect 8. The composition of any one of aspects 1-6, wherein, in the composition, the microbial strain is present in an amount of from about $10^9$ to about $10^8$ colony forming units per mL.

Aspect 9. The composition of any of aspects 1-8, wherein the at least one excipient, diluent, or carrier confers increased stability, wettability, dispersibility, or adherence to a substrate relative to a composition lacking the carrier.

Aspect 10. An extract produced by culturing a microbial strain comprising a DNA sequence exhibiting at least 85% sequence identity to at least one of SEQ ID NOs. 1-6.

Aspect 11. The extract of aspect 10, wherein the DNA sequence exhibits at least 90% sequence identity to at least one of SEQ ID NOs. 1-6.

Aspect 12. The extract of aspect 10, wherein the DNA sequence exhibits at least 95% sequence identity to at least one of SEQ ID NOs. 1-6.

Aspect 13. The extract of aspect 10, wherein the DNA sequence exhibits at least 99% sequence identity to at least one of SEQ ID NOs. 1-6.

Aspect 14. The extract of aspect 10, wherein the DNA sequence exhibits at least 99.5% sequence identity to at least one of SEQ ID NOs. 1-6.

Aspect 15. The extract of any one of aspects 10-14, wherein the extract is substantially free of microbial cells.

Aspect 16. The extract of any one of aspects 10-15, wherein the extract is produced by:
(a) culturing the microbial strain in a culture medium; and
(b) filtering the culture medium.

Aspect 17. A composition comprising the extract of any one of aspects 10-16 and at least one excipient, diluent, or carrier.

Aspect 18. The composition of any one of aspects 1-9 or 17, wherein the composition comprises an emulsion, a colloid, a granule, a pellet, a powder, a spray, a suspension, or a solution.

Aspect 19. The composition of any one of aspects 1-9, 17, or 18, wherein the at least one excipient, diluent, or carrier comprises a surfactant, a solvent, an emulsifier, a buffer, a cryoprotectant, a salt, microbial culture medium, a wetting agent, a bulking agent, an anti-caking agent, a thickener, a clay, a mineral, a wax, a gum, a dye or colorant, a biological waste material, or any combination thereof.

Aspect 20. The composition of aspect 19, wherein the surfactant comprises polysorbate 20.

Aspect 21. The composition of aspect 19, wherein the solvent comprises water.

Aspect 22. The composition of any one of aspects 1-9 or 17-21, wherein the composition further comprises an effective amount of at least one additional active ingredient.

Aspect 23. The composition of aspect 22, wherein the additional active ingredient comprises a fertilizer, a pesticide, an herbicide, or any combination thereof.

Aspect 24. The composition of any of aspects 17-23, wherein the at least one excipient, diluent, or carrier confers increased stability, wettability, dispersibility, or adherence to a substrate relative to a composition lacking the carrier.

Aspect 25. A method for treating or preventing a plant disease caused by a pathogen, the method comprising applying the composition of any one of aspects 1-9 or 17-24 to a plant.

Aspect 26. The method of aspect 25, wherein the composition is applied from about 2 to about 30 days prior to exposure to the pathogen.

Aspect 27. The method of aspect 25, wherein the composition is applied from about 3 hours to about 48 hours after exposer to the pathogen.

Aspect 28. The method of any one of aspects 25-27, wherein applying the composition about 1 day prior to exposure to the pathogen reduces at least one symptom of a disease by about 99%.

Aspect 29. The method of any one of aspects 25-27, wherein applying the composition about 30 days prior to exposure to the pathogen reduces at least one symptom of a disease by from about 30% to about 75%.

Aspect 30. The method of aspect 28 or 29, wherein the at least one symptom comprises blight.

Aspect 31. A method for treating or preventing a plant disease caused by a pathogen, the method comprising applying the composition of any one of aspects 1-9 or 17-24 to at least one environmental component of a plant.

Aspect 32. The method of aspect 31, wherein the at least one environmental component comprises leaf debris, soil, the plant's rhizosphere, or any combination thereof.

Aspect 33. The method of any one of aspects 25-27, wherein applying the composition reduces primary inocula by at least 30% after 5 days.

Aspect 34. The method of aspect 31 or 32, wherein applying the composition reduces primary inocula by at least 75% after 30 days.

Aspect 35. The method of any one of aspects 31-34, wherein applying the composition reduces primary inocula for a period of at least 50 days.

Aspect 36. The method of any one of aspects 25-35, wherein the pathogen comprises a bacterium, a fungus, an oomycete, or a virus.

Aspect 37. The method of aspect 36, wherein the bacterium comprises *Escherichia coli*, *Erwinia carotovora*, *Pseudomonas syringae*, *Ralstonia solanacearum*, *Stenotrophomonas maltophilia*, or *Xanthomonas campestris*.

Aspect 38. The method of aspect 36, wherein the fungus comprises *Calonectria pseudonaviculata*, *Alternaria* tenuissium, *Botrytis cinerea*, *Collectortrichum acutatum*, Collectortrichum frutticola, Collectortrichum gleosporiodes, Collectortrichum *viniferum*, *Fusarium* proliferaturm, *Fusarium solani*, or *Volutella buxi*.

Aspect 39. The method of aspect 36, wherein the oomycete comprises a *Phytophthora* species.

Aspect 40. The method of aspect 39, wherein the *Phytophthora* species comprises P. *capsica*, *P. cinnamomi*, *P. infestans*, *P. nicotianae*, *P. ramorum*, or *P. sojae*.

Aspect 41. The method of aspect 36, wherein the virus comprises a tospovirus or tomato spotted wilt virus.

Aspect 42. The method of any one of aspects 25-41, wherein the plant comprises an ornamental plant, a food plant, an energy crop, a fiber crop, a timber crop, or a combination thereof.

Aspect 43. The method of any one of aspects 25-42, wherein the composition is applied to the roots, leaves, fruits, flowers, stems, or seeds of the plant, or any combination thereof.

Aspect 44. The method of any one of aspects 25-43, wherein the composition is applied to soil, compost, mulch, leaf litter, sawdust, straw, pine straw, wood chips, gravel, plant growing medium, or other material in a bed surrounding the plant.

Aspect 45. The method of any one of aspects 25-44, wherein the plant comprises Fraser fir, *petunia, rhododendron*, annual *vinca*, bell pepper, cucumber, tomato, *hydrangea*, pansy, boxwood, geranium, or *impatiens*.

Aspect 46. The method of aspect 45, wherein the fungus comprises *Calonectria pseudonaviculata* and the plant comprises boxwood.

Aspect 47. The method of any one of aspects 25-46, wherein performing the method reduces at least one symptom of the plant disease by at least 50%.

Aspect 48. The method of any one of aspects 25-46, wherein performing the method reduces at least one symptom of the plant disease by at least 65%.

Aspect 49. The method of any one of aspects 25-46, wherein performing the method reduces at least one symptom of the plant disease by at least 90%.

Aspect 50. The method of any one of aspects 25-46, wherein performing the method reduces at least one symptom of the plant disease by at least 99%.

Aspect 51. The method of any one of aspects 42-50, wherein the at least one symptom comprises leaf yellowing, leaf loss, wilting, dwarfing or hypoplasia, gall formation, mycelium or mold growth, smuts, rusts, sclerotia, tissue necrosis, cankers, blight, rot, hypertrophy, or any combination thereof.

Aspect 52. The method of any one of aspects 25-46, wherein performing the method reduces transmission of the plant disease by at least 50%.

Aspect 53. The method of any one of aspects 25-46, wherein performing the method reduces transmission of the plant disease by at least 65%.

Aspect 54. The method of any one of aspects 25-46, wherein performing the method reduces transmission of the plant disease by at least 90%.

Aspect 55. The method of any one of aspects 25-46, wherein performing the method reduces transmission of the plant disease by at least 99%.

Aspect 56. The method of any one of aspects 25-36, 38, or 42-55, wherein the plant pathogen is a fungus and wherein performing the method lyses at least a portion of fungal conidia, causes defects in formed fungal conidia, suppresses mycelial growth, reduces survival of fungal microsclerotia, reduces sporulation, or any combination thereof.

Aspect 57. A method for treating or preventing a plant disease caused by a pathogen, the method comprising applying to a plant or to a plant growing medium an effective amount of a composition, wherein the composition comprises a microbial strain comprising a DNA sequence exhibiting at least 85% sequence identity to at least one of SEQ ID NOs. 1-6, an extract produced by culturing the microbial strain, or any combination thereof.

Aspect 58. The method of aspect 57, wherein the plant disease comprises boxwood blight.

Aspect 59. A plant treated using the method of any one of aspects 25-53.

Aspect 60. A method for increasing plant growth, the method comprising applying the composition of any one of aspects 1-9 or 17-21 to a plant, so that a treated plant has increased growth compared to an untreated plant.

Aspect 61. The method of aspect 60, wherein the plant comprises an ornamental plant, a food plant, an energy crop, a fiber crop, a timber crop, or a combination thereof.

Aspect 62. The method of aspect 60 or 61, wherein the composition is applied to the roots, leaves, fruits, flowers, stems, or seeds of the plant, or any combination thereof.

Aspect 63. The method of any one of aspects 60-62, wherein the composition is applied to soil, compost, mulch, leaf litter, sawdust, straw, pine straw, wood chips, gravel, plant growing medium, or other material in a bed surrounding the plant.

Aspect 64. The method of any one of aspects 60-63, wherein performing the method delivers an increased amount of an auxin to the treated plant compared to an untreated plant.

Aspect 65. The method of aspect 64, wherein the auxin comprises indole-3-acetic acid.

Aspect 66. The method of any one of aspects 60-65, wherein performing the method increases an amount of nitrogen available to the treated plant compared to an untreated plant.

Aspect 67. The method of any one of aspects 60-66, wherein performing the method increases an amount of soluble phosphate available to the treated plant compared to an untreated plant.

Aspect 68. The method of any one of aspects 60-67, wherein performing the method increases a concentration of siderophores available to the treated plant compared to an untreated plant.

Aspect 69. The method of any one of aspects 60-68, wherein the plant comprises Fraser fir, *petunia, rhododendron,* annual *vinca,* bell pepper, cucumber, tomato, *hydrangea,* pansy, boxwood, geranium, or *impatiens.*

Aspect 70. The method of any one of aspects 60-69, wherein increasing plant growth comprises increased biomass of the treated plant compared to an untreated plant.

Aspect 71. The method of any one of aspects 60-70, wherein increasing plant growth comprises increased fruit production of the treated plant compared to an untreated plant.

Aspect 72. The method of any one of aspects 60-71, wherein increasing plant growth comprises increased production period of the treated plant compared to an untreated plant.

Aspect 73. The method of any one of aspects 60-72, wherein increasing plant growth comprises increased productive lifespan of the treated plant compared to an untreated plant.

Aspect 74. The method of any one of aspects 60-73, wherein increasing plant growth comprises increased foliage area of the treated plant compared to an untreated plant.

Aspect 75. The method of aspect 74, wherein increased foliage area comprises a greater number of leaves, a larger surface area per individual leaf, or any combination thereof.

Aspect 76. The method of any one of aspects 60-75, wherein performing the method increases plant growth by at least 35% for an untreated plant compared to an untreated plant.

Aspect 77. The method of any one of aspects 60-76, wherein performing the method increases plant growth by at least 55% for an untreated plant compared to an untreated plant.

Aspect 78. The method of any one of aspects 60-77, wherein performing the method increases plant growth by at least 75% for an untreated plant compared to an untreated plant.

Aspect 79. A method for increasing plant growth, the method comprising applying to a plant or to a plant growing medium an effective amount of a composition, wherein the composition comprises a microbial strain comprising a DNA sequence exhibiting at least 85% sequence identity to at least one of SEQ ID NOs. 1-6, an extract produced by culturing the microbial strain, or any combination thereof, so that a treated plant has increased growth compared to an untreated plant Aspect 80. A plant treated using the method of any one of aspects 60-79.

EXAMPLES

The following examples are put forth so as to provide those of ordinary skill in the art with a complete disclosure and description of how the compounds, compositions, articles, devices and/or methods claimed herein are made and evaluated, and are intended to be purely exemplary of the disclosure and are not intended to limit the scope of what the inventors regard as their disclosure. Efforts have been made to ensure accuracy with respect to numbers (e.g., amounts, temperature, etc.), but some errors and deviations should be accounted for. Unless indicated otherwise, parts are parts by weight, temperature is in ° C. or is at ambient temperature, and pressure is at or near atmospheric.

Example 1: Materials and Methods for Assessment of Control of Boxwood Blight

SSG Isolation, Growth Conditions, Cell Suspension, and Cell Free Supernatant (CFS)

Figure 4:
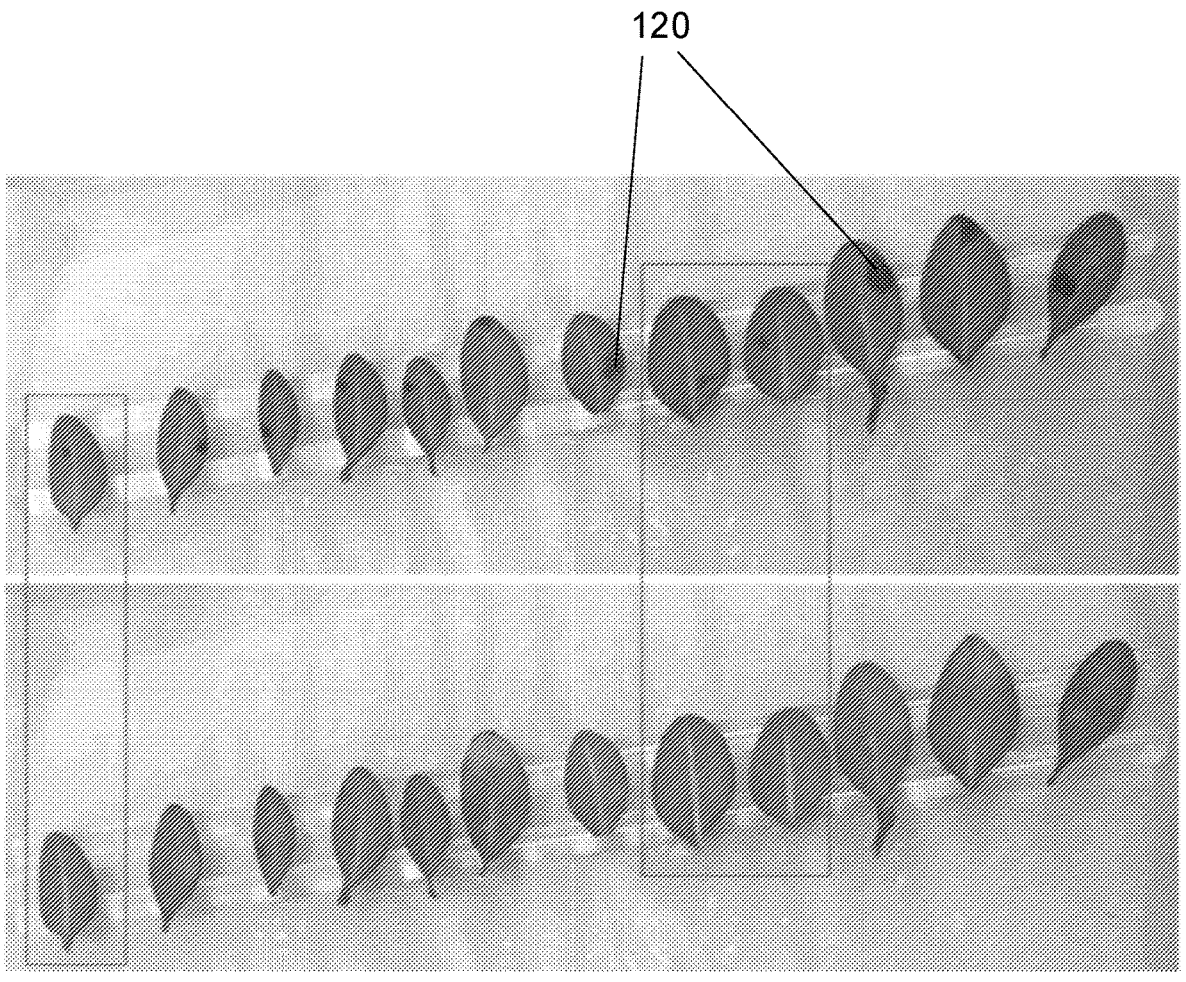
FIG. 4 shows changes (reversion of symptoms) at inoculation sites on detached boxwood leaves after receiving a drop containing conidia of *Calonectria pseudonaviculata*. Top. Water-soaked lesion appeared on individual leaves 2 days after inoculation (dpi). Bottom. Water-soaked lesions disappeared from three leaves (in rectangle) while progressing to show blight symptoms and signs on other leaves at 7 dpi.

In an experiment, individual detached leaves of *Buxus sempervirens* 'Justin Brouwers' were inoculated with a drop of conidia suspensions of *Calonectria pseudonaviculata* (Cps) and water-soaked lesions appeared at two days post inoculation (dpi). While lesions on most of these leaves expanded by 7 dpi, a few disappeared (FIG. 4). SSG was isolated from the symptom reversed leaves. These leaves were surface sterilized with 70% ethanol, cut into small pieces, and vortexed in sterile deionized water (SDW) for 10 min. The supernatant was plated on potato dextrose agar (PDA, Sigma-Aldrich, St. Louis, MO, USA) after brief precipitation by gravity and grown for 48 h at 25° C. To isolate SSG, colonies on the plates were grouped and subjected to selection by dual culture assay against Cps.

SSG was grown in 4 mL nutrient broth (Sigma-Aldrich, St. Louis, MO, USA) at 28° C. for 24 h as a stock culture for long-term storage at −80° C., for short-term storage at 4° C., as streak culture on nutrient agar, and other uses. For fresh stock culture preparation, a single colony was taken from the plate and grown in PD broth or nutrient broth overnight at 28° C. To make a large amount of culture, 1 mL of the stock culture was grown in 150 mL for 40 h. The culture was centrifuged at $14210\times g$ for 15 min to suspend the pellet for preparation of cell suspensions and to pass the supernatant through a 0.22 μm-filter for preparation of cell-free supernatant (CFS).

Growth Conditions of Cps and Conidial Inoculum Preparation

A Cps isolate, Sb1, from sweet box (*Sarcococca hookeriana* var. *humilis*) was used. The isolate was grown at 25° C. and maintained at 20° C. on PDA as described previously. The conidia for plant inoculation was produced using a liquid culture in PD broth which produced a high concentration of inocula as described in the literature. Conidia were suspended in 0.01% polysorbate 20, and the concentration of conidial suspensions was determined with a hemocytometer.

Dual Culture Assays on Antagonism of the Isolates

Dual-culture assays were conducted in 90-mm PDA plates. A mycelial plug of the Cps was placed in the center of the plate and equidistantly surrounded with two streaks of the control (nutrient broth) and a 24 h-culture of a test bacterial isolate in nutrient broth (FIG. 1). For each test bacterial isolate, the assay included three replicate plates and was repeated twice. All plates were incubated at 25° C. in the dark. Cps colony growth diameters were measured at 1, 2 and 4 weeks.

Microscopy of Effects of SSG on Cps Conidia Morphogenesis

A time-course assay was conducted in 24-well plates to determine the effects of SSG on Cps conidia survival, germination and differentiation. In each three replicate wells, 100 μL of Cps suspension at $10^4$ conidia/mL was added into 700 μL of acidic PD broth as control, SSG CFS, or $10^7$ colony forming units (cfu)/mL in PD broth. After being kept in the dark at 25° C. for 1, 4, 8, 24 and 48 h, treatments were examined and photographed for conidia lysis, germination, and differentiation under an Olympus IX71 inverted microscope at magnification of 100×. The assay was repeated once and each treatment included three replicate wells.

Microscopy of Effects of SSG on Survival of Microsclerotia from Leaf Tissue

Microsclerotia were extracted from infected boxwood leaves 8 weeks after inoculation as described in the literature. 30 μL of the suspension was added into 700 μL of PD broth as the control, SSG CFS, or $10^7$ cfu/mL in PD broth in a 2-mL tube. The tubes were kept at 25° C. in the dark and a 100 μL aliquot of the suspension was spread on acidic PDA at 1, 4, 8, 24, 48 h and 2 weeks after treatment and recorded for number of Cps colonies after 7 days at 25° C. in the dark. Microsclerotia survival at 1 h and 14 days after treatment was also examined and photographed under an Olympus IX71 inverted microscope at magnification of 40×. Each treatment included 3 replicate tubes.

Plant and Growth Conditions

*Buxus sempervirens* 'Justin Brouwers' in 1 gallon (7 inch) pots was used in the study. Plants were kept in the field plot at the Virginia Tech Hampton Roads Agricultural Research and Extension Center (HRAREC), watered, and fertilized regularly before the experiment. Since Cps is a high alert plant pathogen in the USA, plants were transferred at the time of experiments to the laboratory, watered regularly or as needed, and tested at 23° C. with a 9 h light/15 h dark cycle.

Plant Treatments with SSG

Treatments included SSG CFS, the suspension of the cell pellet in 200 mL 0.01% polysorbate 20, its dilutions, and the control, 0.01% polysorbate 20 or nutrient broth. A 10-fold serial dilution was made from the cell suspension with 0.01% polysorbate 20. The concentration of the suspension was determined using the suspensions of 7th and 8th dilutions that were plated onto PDA for cfu/mL. Treatments also included treatment time and intervals before and after the challenge of plants with Cps inoculum. Plant treatment before Cps inoculation included a lead time of 2, 10, 20, and 30 days while that after Cps inoculation included a post time of 3, 24, and 48 h.

At treatment, plants in each of three pots in a large plastic container (22×13×17.5 in) before or after Cps inoculation, were sprayed with 20 mL of the tester. Plants were kept in the containers with covers for 24 h after spray. All experiments were repeated at least once.

Plant Inoculation with Cps and Disease Assessment

Plants before and after treatment were inoculated with a Cps conidial suspension at $1\text{-}4\times10^4$ conidia/mL. Plants in each pot were sprayed with 20 to 50 mL inoculum depending on the Cps concentration used. Plants after inoculation were kept in the containers with covers for 48 h to promote plant infection and then without covers for additional 5 days for disease development. The number of infected leaves in each pot were counted to calculate disease incidence. The % efficacy of each treatment for control of boxwood blight was computed by dividing the difference in disease incidence between the control and the treatment by the control disease incidence.

Effects of SSG on Cps Sporulation from Leaf Litters

Six boxwood plant pots were placed into upside-down empty pots in the containers to prevent cross contamination during the experiment and plants were watered 24 h before treatment. Diseased leaf litters were harvested from diseased plants 3 weeks after inoculation with Cps conidia at $5\times10^4$/mL and stored at 4° C. for over 30 days after drying. Each container was sprinkled with about 100 leaves. Half of the pots were sprayed with 70 mL 50% culture (about $10^{7\text{-}8}$ cfu/mL) onto the litter under the plants, and another half of the ports were sprayed with the same amount of 50% of the same media used for the culture as control. The containers were watered overhead every other day until the end of the experiment to allow inoculation by splash to plants after covered with lids for 24 h after treatment. Ten of the treated leaves were sampled from each pot at 5, 10, 20, 30, 40, and 50 days post-treatment (dpt) and placed in a moist crisper for 4 days for Cps sporulation. To quantify sporulation, the leaves were suspended in 10 mL 0.01% polysorbate 20 by vortexing for 10 min and the suspension was loaded onto a hemocytometer for conidia count under a microscope. Each experiment containing 6 replicate pots was conducted three times.

Effects of SSG on Boxwood Protection from Cps Splash from Leaf Litter

At 50 dpt, the branches and leaves including fallen ones in the pots of the leaf litter treatments in two experiments were counted to determine leaf variation between the treatments and the ratio of leaves and branches. The latter was used to estimate the total leaves of each pot in all experiments. Branches and diseased leaves in all 6 pots of each treatment were counted in all experiments. Disease incidence of treatments was determined based on these counts and leaves per branch. The experiment was repeated twice.

Assessment of SSG Survival in the Soil after the Treatment

At 50 dpt of treatments of above experiments, a 100 mg soil sample was taken 3 cm depth under the surface of each treatment pot to determine SSG survival. Individual samples were suspended in 10 mL SDW by vortexing for 15 min. After this settled for 10 min, 100 μL of the suspension was spread onto a PDA plate. Colonies were counted after the plates were incubated at 25° C. for 48 h. Colonies for three plates were counted for each sample.

Taxonomy of SSG Isolates

DNA extracted from SSG cells was used for taxonomy by sequencing and restriction fragment length polymorphism (RFLP). For16S rRNA gene PCR and sequencing, universal primers 27F, 968F, and 1410R were used. For RecA gene PCR and sequencing, BCRI and 2 primers were used. Sequences were blasted against known sequences of microbes to match to a species level.

In addition to sequencing, SSG PCR products of RecA were subjected to HaeIII and Mn/I-based RFLP analysis to place SSG to a genomovar of *Burkholderia cepacia* complex (Bcc). DNA of SSG was also amplified with specific primers for *B. cepacia* epidemic strain marker (BCESM) to differentiate SSG from clinical strains of Bcc.

SSG was streaked on *Burkholderia cepacia* selective agar (BCSA, LabGenome, Houston, TX, USA) and incubated at 25, 35, and 42° C. for 72 h to confirm its membership in Bcc.

Statistics

Standard errors were calculated from standard deviation and number of replicates from each assay with Microsoft Excel. T-test at equal variances in Excel was used for evaluating statistical significance between treatments according to the least significant difference (LSD) at P=0.05.

Example 2: Results and Discussion for Assessment of Control of Boxwood Blight

SSG Inhibits Cps Growth, Conidium Morphogenesis, and Microsclerotium Germination SSG was selected among eight bacterial isolates from symptom-reversed leaf area of boxwood after inoculation with Cps because of its superior antagonism presented in the dual culture assay. Mycelial growth of plugs in the center of plates were not (or were, but only to some extent) suppressed by other isolates during the assay. In contrast, mycelial growth was suppressed by SSG from beginning of the assay and did not change through the end of the assay.

The time course study showed that both the cells and cell free supernatant (CFS) of SSG affected conidium morphogenesis. Conidia in the SSG cell suspension did not germinate at any time point, and more and more of them lysed with increasing exposure time. None were present at 24 h after the treatment.

Similarly, those in CFS had a significantly lower germination rate than the control (P<0.0001) indicating lysis of conidia. However, there were half empty conidia which were not apparent in the cell treatment. Furthermore, very few germlings of CFS treatment developed and formed hypha. In contrast, germination rate of control was high at the first hour and climbed with increase of incubation time and formed hypha and mycelia.

Both CFS and SSG also suppressed the survival of Cps microsclerotia from leaf litters. Isolated microsclerotia did not form colonies at 4 h after incubation in SSG cell suspension and in CFS for 8 h. In contrast, they formed colonies in control under the same conditions. In media broth, the control had massive mycelia growth at 2 weeks after the treatment while CFS and cells treatments grew nothing although those in CFS survived longer.

SSG Reduced Disease Incidence of Boxwood Blight

Figure 2:
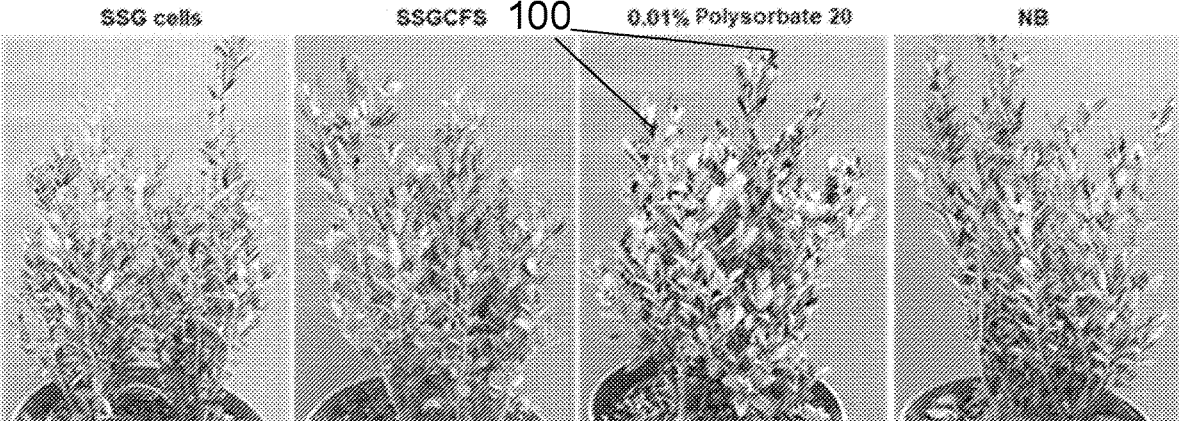
FIG. 2 shows protection of *Buxus sempervirens* 'Justin Brouwers' plants with SSG cells and cell-free supernatant (CFS) in comparison with controls (0.01% polysorbate 20 and nutrient broth) 7 days after inoculation with Cps conidia

With reference to FIG. 2, SSG also reduced disease incidence of boxwood blight. Compared to the controls, plants treated with cell suspension in 0.01% polysorbate 20 at >$10^8$ cfu/mL and CFS received 99.6% and 66.9% protection against blight 100, respectively, when inoculated with conidia. Protection by cell suspension decreased with decreasing number of cells. It reduced to 85.7% at $10^7$ cfu/mL, although protection was not significantly different from the higher concentration. There was significant reduction of protection when the cell concentrations were reduced between $10^{3-6}$ cfu/mL and plants received 35 to 40% protection. However, plants had little protection when cells were further diluted.

Lead time for treatment before the inoculation also affected the plant protection efficacy. Efficacy did not change significantly between lead time 2 days and 10 days. Efficacy was reduced when lead time was 20 days or longer. However, plants received more than 50% protection, indicating the persistence of antagonism of SSG.

Treatment after Cps inoculation was less effective compared to pretreatment. However, infection was suppressed if inoculated plants were treated early. Results varied compared to using cell suspension of CFS (Table 1). Infection was reduced by 99%, 81%, and 61% when inoculated plants were sprayed with SSG cells at >$10^8$ cfu/ml at 3, 24, and 48 h after inoculation. There was decrease of efficacy with progression of infection. However, when CFS was used, 99.2% of plants were protected from infection at 48 h after inoculation.

TABLE 1

Effect of Post-Treatment Time with SSG after Inoculation with
*Calonectria pseudonaviculata* (Cps) on Disease Incidence

| Time Post Inoculation (h) | CK1 | Cells[x] | Reduction | CK2 | CFS[y] | Reduction |
|---|---|---|---|---|---|---|
| 3 | 65.1 ± 7.3[z] | 0.7 ± 0.2 | 99.0 | NA | NA | NA |
| 24 | NA | 12.3 ± 1.2 | 81.2 | NA | NA | NA |
| 48 | NA | 25.2 ± 2.8 | 61.3 | 59.9 ± 7.1 | 0.5 ± 7.1 | 99.2 |

[x]Cell suspension at >$10^8$ cfu/mL controlled by 0.01% polysorbate 20. Disease incidence reduction was calculated compared to the control at 3 h post inoculation.
[y]Cell-free supernatant from 40 h cell culture and controlled by the nutrient broth medium. Disease incidence reduction was calculated compared to the control at 48 h post inoculation.
[z]Average of disease incidence (%) by Cps inoculation at 48 h post inoculation with Cps at 1-5 × $10^4$ conidia/mL from 6 replicate pots of plants from two independent experiments. Numbers after ± indicate standard error.
NA = Not Available SSG Reduced Cps Sporulation and Protected Plants from Leaf Litters Cps sporulation on leaf litters after sprayed with SSG culture was significantly reduced compared to the control. The reduction, about 40,000 conidia/cm² was consistent at each sampling time despite of nature reduction. Conidium production of SSG treatment was almost controlled at 30 or longer exposure. While many conidia were observed for the control, there were very few conidia at the last sampling time (50 dpt). Meanwhile, SSG colonies were recovered from the sample soil indicating survival of SSG in soil. The density of cells in the soil was about 18,500 (±42) cfu/g.

Figures 3A, 3B, 3C:
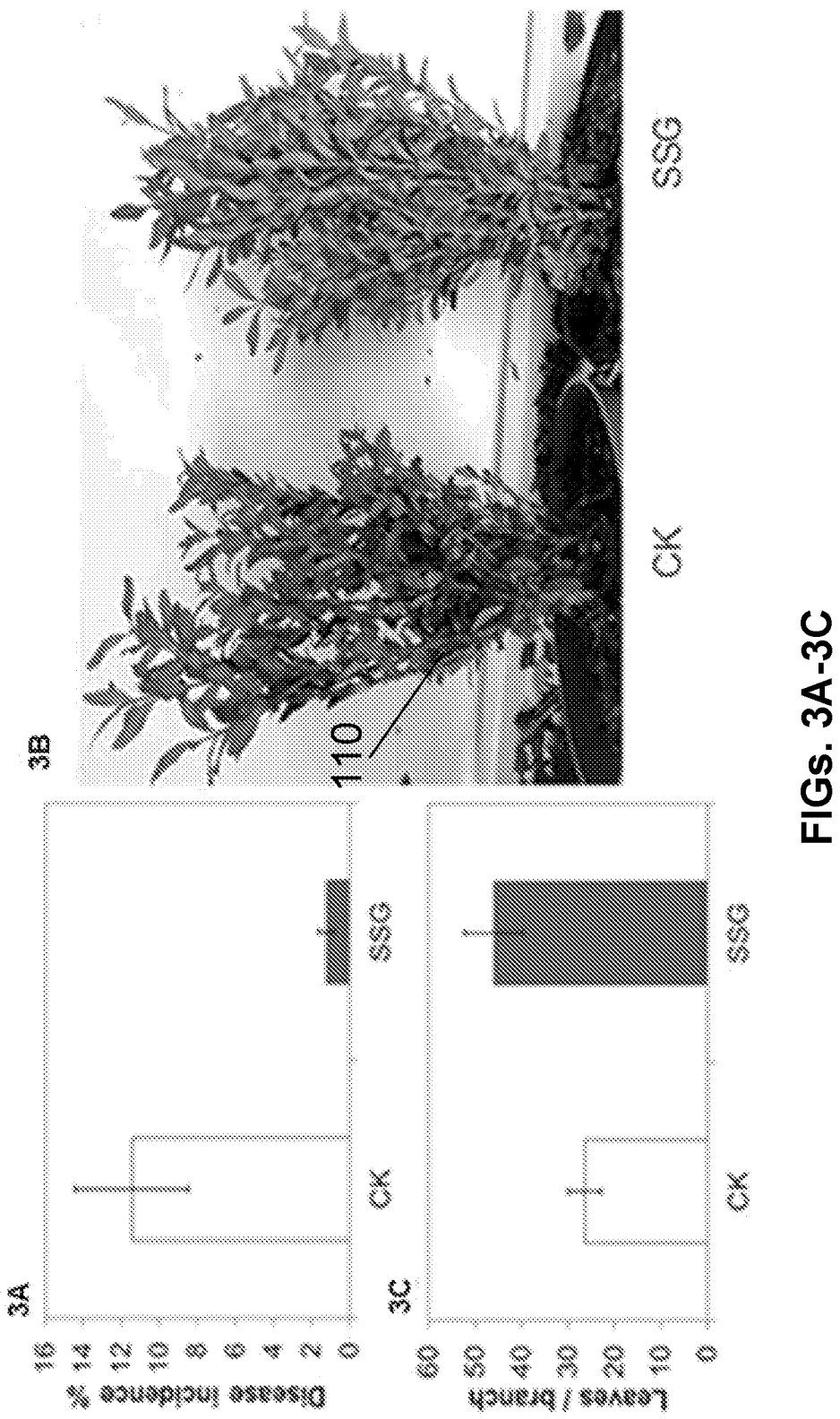
FIGS. 3A-3C show the effect of SSG on plant protection against Cps from leaf debris.

SSG also affected plant infection through leaflitters and plant growth. Plants in the pots with treated leaf litters by SSG culture had significantly lower disease incidence (1.2%) than the control (11.4%) 50 dpt after the treatment (FIG. 3A). With reference to FIG. 3B, disease 110 occurred mainly on the bottom of the leaves, indicating that the inoculum originated from the litters. Furthermore, SSG pots had significantly more leaves compared to the control pots, indicating plant growth during the treatment.

Identification of SSG

DNA of SSG was sequenced for 16S rRNA gene. The sequence of SSG matched at 99% identity with many of those know species in the *Burkholderia cepacia* complex (Bcc). To confirm that SSG was a member of Bcc, SSG was grown on Bcc selective media (BCSA) at 25, 37, and 42° C. Sage colonies appeared in the plates at 25 and 37° C. and the media color turned to yellow after 48 h, indicating SSG as a typical Bcc bacteria. To further classify SSG, DNA of SSG was amplified for RecA gene and digested with HeaIII and MnII restriction enzymes. However, RFLPs showed inconsistent patterns between genomovars I and III. The sequence of the RecA gene of SSG placed SSG in different subtrees despite that it matched several known species in Bcc and had the best match to *B. cepacia* strains. SSG was negative for *B. cepacia* epidemic strain marker (BCESM) when the DNA was further analyzed. These results indicated that taxonomy of SSG in Bcc was not clear but differed from clinical strains.

DISCUSSION

This study identified SSG as a potential biofungicide of boxwood blight from boxwood endophyte isolates. SSG provided strong protection against boxwood blight when the cells at higher than one million cfu/mL and cell free supernatant (CFS) of cultures were used to pretreat the plant 10 days before inoculation of the pathogen Cps. The efficacy is superlative compared to those previously reported non-indigenous fungal *Trichoderma koningiopsis* and bacterial *Pseudomonas protegens*, and its control efficacy is comparable to that of currently used fungicides. SSG is also very effective in controlling infection at the early stage after the inoculation. Symptoms from Cps infection on susceptible English Boxwood can appear as early as two days after inoculation following penetration and colonization on at 5 and 12 h. 99% of plants were prevented from symptom production when treated with SSG cells at >$10^8$ cfu/mL 3 h after inoculation and CFS of SSG 48 h after inoculation with Cps, suggesting that SSG may be used to terminate the infection process and stop the penetration of the pathogen. Furthermore, SSG gradually degraded Cps in leaf debris. Since SSG can survive in the soil at least 50 days as indicated by sampling at the end of the experiment, it may be used as a sustainable biosanitizer for pathogen inocula in/on the soil and diseased leaf litters. Plant disease biocontrol plays an important role in Integrated Pest Management (IPM) systems in reducing dependence on chemical inputs.

With a high efficacy in boxwood blight control and plant protection, SSG as one of few plant Burkholderial endophytes reported, has great potential to fulfill the task and beyond.

Boxwood protection by SSG may be derived from direct and indirect antagonisms involving complex modes of action. Direct antagonisms is demonstrated by conidium lysis and no germination of microsclerotia in SSG cells. The bacterial metabolites greatly contributed to the killing and suppression. First, diffusion of SSG suppressed mycelium growth of Cps. Second, conidia had poor survival and germination and abnormal differentiation, and microsclerotia decreased survival after incubation with CFS. Similarly, CFS suppressed early plant infection and reduces disease incidence. However, SSG volatiles are unlikely involved because no suppression was observed when dual cultures of SSG and Cps were placed in the divided plates. Direct antagonism of SSG may be attributed to production of antibiotics commonly found in Bcc species such as pyrrolnitrin, occidiofungins, and cepafungins (glidobactins).

Bcc species produce pyrrolnitrin optimally late in the growth phase and accumulated a main portion in their cells. The fact that CFS rescued plants from infection by Cps at 48 h after inoculation while SSG cells only did for the infection at 3 h but not later also support involvement of antibiotics appears linked to presence and amount of pyrrolnitrin. However, whether and how these antibiotics and if there novel antibiotics or metabolites involve direct antagonisms of SSG to Cps remained to be further investigated. In addition to metabolites, SSG cells may also contributed the direct antagonism of SSG. In the in vitro experiments, conidia lysed in the SSG cell suspension were significantly more than those in CFS, suggesting that SSG cells may out-compete or kill Cps during germination and penetration. Further investigation of direct interaction between bacterial cells and Cps using lockout of antibiotic gene SSG or drugs blocking the release of antibiotics is warranted to confirm this mode of action of SSG.

Indirect antagonism by SSG is shown by the presence of constant medium levels of protection from treatments at extended lead time longer than two days and cell concentrations at 1,000 cfu/mL or higher. Bcc bacteria contain complex QS systems for the regulation of the production of a variety of extracellular products including siderophores and antibiotics and for plant colonization and growth. Although it is not clear how SSG interacts with plant, same level of protection resulted from different concentrations or survival status of cells does not look like a consequence of antibiotics alone but more like a consequence of plant defense elicited by threshold signals of SSG at treatment. Another implication of the involvement of indirect antagonism is from the fact that SSG was one of the endophytes from the leaf area of symptom reversion after Cps inoculation. However, it is not clear what role SSG played in the healing process. Bacterial endophytes including *Burkholderia* have many traits contributing to indirect antagonisms. They produce growth regulators and other chemicals to promote plant defense and growth. *Burkholderia* produce siderophores, giving a competitive advantage at scavenging for iron. They also produce 1-aminocyclopropane-1-carboxylate (ACC) deaminase, fix nitrogen, and solubilize phosphate for plant growth promotion.

SSG as a highly effective *Burkholderia* antagonistic endophyte for Cps and possesses great potential in controlling boxwood blight. However, like other bacterial biocontrol agents and fungicides, SSG does not work at its best for more than 10 days for pretreatment. This may be due to decrease of survival of SSG on plant surface or limited entry into plant tissue as suggested by reduction of efficacy with increased treatment lead time.

*Burkholderia* has been recovered from various environments. In this study, SSG was isolated from plant tissue and survived in soil for at least 50 days. It is likely that light and moisture conditions may be the major factors associating SSG survival on leaf surface and in soil and plant tissue. Another issue that may be encountered in the application of SSG is its safety. SSG belongs to Bcc and is very similar to *B. cepacia* in sequence in genomovar I although it is phylogenetically different from any of the known strains in the genomovar that are dominant with environmental strains. More importantly, SSG was originated from a plant and is negative for the human virulent BCESM marker, confirming its difference from clinical strains associated with cystic fibrosis patients.

Example 3: Materials and Methods for Effects of SSG on Other Plant Pathogens/Diseases Plant Pathogen Cultures and Growth Conditions Plant bacterial, fungal, and oomycete pathogens including *Fusarium solani* (11B07), *Volutella buxi, Phytophthora capsici* (22H3), P. cinnamormi (30D6), *P. infestans* (27E7), *P. nicotianae* (1B11), *P. ramorum* (32G2), *P. sojae* (28G4), *E. coli* (DH52) (60622), *Erwinia carotovora* (60627), Psuedomonas *syringae* (60625), *Ralstonia solanacearum* (60622), *Stenotrophomonas maltophilia* (PE1-sy), and *Xanthomonas* campastris (60627) were used in this study. Strain/isolate cultures of fungi, *Phytophthora*, and bacteria were plated out from long term storage and grown on PDA, V8 agar, and nutrient agar plates, respectively at 25° C. before tests were performed.

Dual Cultural Assays

Streak and disk methods described in the manuscript were used for tests of culture growth of bacterial and fungal/*Phytophthora* pathogens, respectively in this study. Each test included three replicate plates and was repeated at least once.

Similar methods used for conidia of Cps described in Example 1 were used for investigating the effects of SSG on the survival and germination of zoospores. Zoospore were produced using a plug and wet plate method described previously. Specifically, 100 μL zoospore suspension at $10^5$/mL was added into 2 mL PDB (CK), CFS from 40 h-culture in PDB, or suspension of SSG cells in PDB and incubated at 23° C. Zoospore behavior was observed under a microscope after 24 h.

Plants and Growth Conditions

Test plants include annual *vinca* (*Catharanthus* 'Little White'), cucumber (*Cucumis sativus*), pepper (*Capsicum*), rhododendron (*Rhododendron catawbiense* 'Boursault'), and tomato (*Solanum lycopersicum*). Plants except for *rhododendron* were 1-gallon plant gifts from Sunder's Brothers and were seeded in a greenhouse under mist. Seedlings with four leaves were transferred into 4-inch pots and grown in the greenhouse for an additional 4-8 weeks. Plants were fertilized once with slow-release fertilizer and watered 2-3 times each week before use.

Plant Protection Against Diseases

Five phytopathosystems with plants and *Phytophthora* spp described above were investigated. Both treatment and inoculation were conducted in the large containers described in Example 1 in the laboratory. Plants were pretreated 48 h with the diluted cell culture or resuspended and diluted cell culture with 0.01% polysorbate 20 before inoculation. Controls were the same solution (nutrient broth, or 0.01% polysorbate 20) without the bacterial culture. Plants were kept in the containers with lids to keep moisture for 24 h after treatment with 30 mL for plants in the 4 inch pots and 50 mL for plants in the 1-gallon pots at $10^{7-8}$ cfu/mL. Inoculation with zoospores was conducted after the lids had been removed for 24 h. Inoculum concentrations ranged from $1.3 \times 10^3$/mL to $2 \times 10^4$/mL, and 25 mL or 75 mL was sprayed on plants in each 4 inch and 1-gallon pot, respectively. Inoculated plants were kept in containers with lids for 24 h and without lids for 1 week for infection development. Total leaves, infected leaves, or lesion number on leaves was recorded to determine the disease incidence. Each treatment in the experiment for a phytopathosystem included three replicate plant pots. Experiments were repeated twice for annual *vinca, P. nicotianae*, and *rhododendron* with *P. ramorum*, once for pepper or cucumber with *P. capsici*, and none for tomato with *P. infestans*.

Example 4: Results and Discussion for Effects of SSG on Other Plant Pathogens/Diseases Effects of SSG on Culture Growth of Varieties of Plant Pathogens SSG was tested for suppression of cell and mycelium growth on isolates/strains of 14 bacteria, fungal and *Phytophthora* species. In the 6 bacterial strains tested, significant inhibition was observed on four, including Psuedomonas *syringae, Stenotrophomonas maltophilia, Xanthomonas campestris*, and *E. coli*. Among them, *Xanthomonas* campastris was most vulnerable, with a suppression zone nearly 3 cm in diameter. However, there was no suppression on *Erwinia carotovora*, and suppression on *Ralstonia solanacearum* was not significant, suggesting the antagonistic spectrum of SSG on bacteria is limited.

SSG inhibited the growth of all test fungi and *Phytophthora*. Among *Phytophthora*, the growth of P. irifestans, *P. ramorum*, and *P. sojae* were totally suppressed, although *P. capsici, P. cinnamomi*, and *P. nicotianae* were not. This difference may result from growth speed of the species on V8 agar. The former three species grew slow so that they may be caught up by diffusion of SSG strips while the latter three grew fast, and the first grown mycelia were not affected.

Suppression on *Phytophthora* by metabolites from SSG was also shown with zoospores. Zoospores in PDB germinated and developed mycelia after 24 h incubation. In contrast, most zoospores in CFS disappeared or lysed. However, those in SSG cell suspension in PDB appeared less affected. One third of them also germinated, although the germlings were weak and the hyphal development was poor. This suggests that SSG metabolites are responsible for zoospore degradation and germination suppression and are effective at a certain concentration that the cells did not achieve because of resuspension.

Effects of SSG on *Phytophthora* Diseases

Figures 6A, 6B, 6C, 6D:
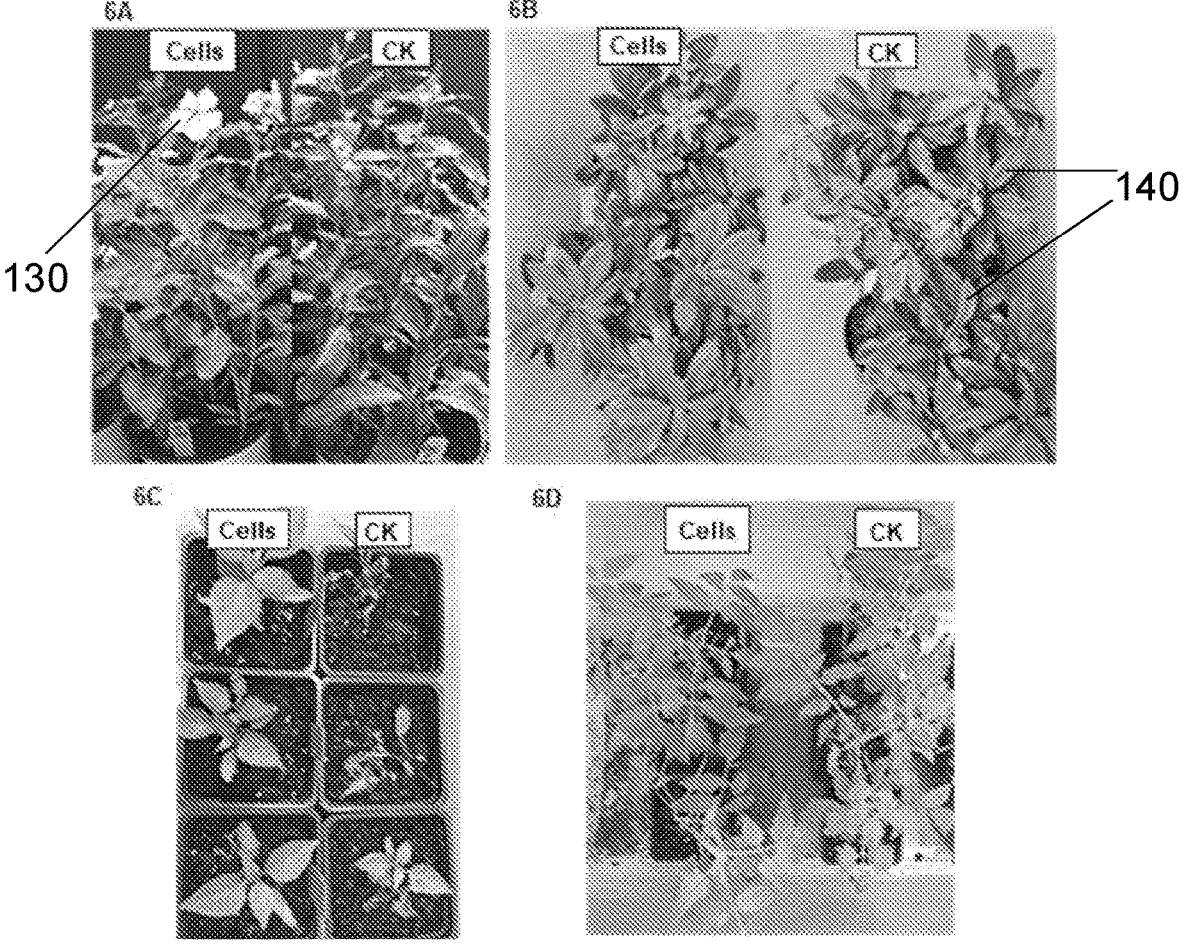
FIGS. 6A-6D show plant protection against *Phytophthora* species by SSG.

Plants of annual *vinca*, cucumber, pepper, *rhododendron*, and tomatoes were tested against *P. nicotianae, P. capsici, P. ramorum*, and *P. infestans*, respectively, after being treated with SSG (see FIGS. 6A-6D). With reference to FIG. 6A, annual *vinca* received excellent protection against *P. nicotianae* as evidenced by increased number of/larger flowers 130. Shoot and leaf infection was reduced by 98% and 96%, respectively when cell culture of SSG was used. The reduction was 97 and 91%, respectively, with the resuspended cells and 85% and 71% with CFS. These results indicate that using cells or CFS alone reduced disease severity and using both cells and metabolites of SSG gave the best protection of plants. The latter may involve direct and indirect antagonism.

Efficacy of plant protection against the pathogen by SSG was also significant in *rhododendron-P. ramorum* system. With reference to FIG. 6B, resuspended SSG cells allowed 60% reduction of leaf infection 140 and 80% reduction of lesions. Efficacy of SSG decreased with extended treatment lead time. However, reduction rates of pretreatments of 1 and 2 weeks were same (40%), indicating the presence of induced resistance. It is not clear whether the efficacy may improve with SSG culture.

Plant protection in cucumber/pepper-*P. capsici* by SSG was not as good as in the above phytopathosystems although SSG culture was not also used in those experiments. Between CFS and suspended cells, better results were obtained with the latter. They reduced plant infection of pepper and cucumber by 55% and 33%, respectively, compared with CFS that reduced the infection by 27% and 17%. No protection was shown for tomato against *P. infestans*. The lower efficacy of SSG on these systems likely results from the susceptibility of test plants to SSG. Various levels of plant toxicity was observed on the test plants treated with CFS and cells alone which appeared associated with the tenderness and hairy status of plant. The more tender the plants, the less protection. The hairy cucumber and tomato plants had little protection.

Example 5: Materials and Methods for Potent *Burkholderia* Endophyte Against Boxwood Blight Caused by *Calonectria pseudonaviculata*

Cps Isolate and Conidia Production

Cps isolate Sb1 (12A01) was used in this study. This isolate, although recovered from affected sweet box (*Sarcococca hookeriana* var. *humilis*), was part of the same clone introduced to a private garden via infected English boxwood and has the same virulence as those from boxwood on the same garden as shown in a comparative study. Cultures were grown and maintained at 25° C. on Difco™ potato dextrose agar (PDA, Becton, Dickinson and Company, Sparks, MD, USA). Conidia were produced using fresh potato dextrose broth (PDB). Briefly, a small amount of mycelia was scraped from the culture surface then evenly distributed in 90 mm plates with fresh PDB. After a 4 day incubation at 25° C., the nutrient medium was decanted. Mycelial mats that formed and were attached to the plate bottom were rinsed with sterilized distilled water (SDW). These washed plates were then placed under fluorescent light at 1200 lux to induce the production of conidia. Conidia were harvested with SDW or 0.01% polysorbate 20 (Croda Inc., New York, NY, USA) into a beaker; spore concentration was determined with a hemocytometer.

Plant Growth Conditions and Biosafety Measures for all in-Planta Inoculation Studies

*Buxus sempervirens* 'Justin Brouwers' boxwood was used in all inoculation studies. Blight-free liners were donated by Saunders Brothers Inc. (Piney River, VA, USA). Two liners were potted in a 15 cm plastic pot with pine bark-based potting mix and fertilized once with slow-release fertilizer (Harrell's LLC, Lakeland, FL, USA). Plants were irrigated up to three times a day, depending upon the time of year, and maintained on a gravel pad until use at the Virginia Tech Hampton Roads Agricultural Research and Extension Center in Virginia Beach, VA, USA.

To prevent Cps from spreading to nearby boxwood plantings, all inoculation studies were done in a laboratory with restricted access. During each experiment, plants were placed in Ultra™ Latching Storage Boxes (66 cm×41 cm×50 cm, Sterilite Corporation, Townsend, MA, USA) to further contain the diseased plant materials. At the termination of experiments, all used plants and planting materials were autoclaved before disposal, while used boxes and other tools are washed and decontaminated with 70% ethanol.

Isolation and Selection of the Bacterial Endophyte from Boxwood Leaves with Unusual Response to Cps Inoculation Detached leaves of Justin Brouwers boxwood were washed in tap water then surface sterilized with 70% ethanol and inoculated with a drop of Cps conidia. Water-soaked lesions developed on individual leaves within 2 days. With reference to FIG. 4, however, not all of these lesions 120 progressed further; instead, some disappeared at 7 days post-inoculation.

Figure 14:
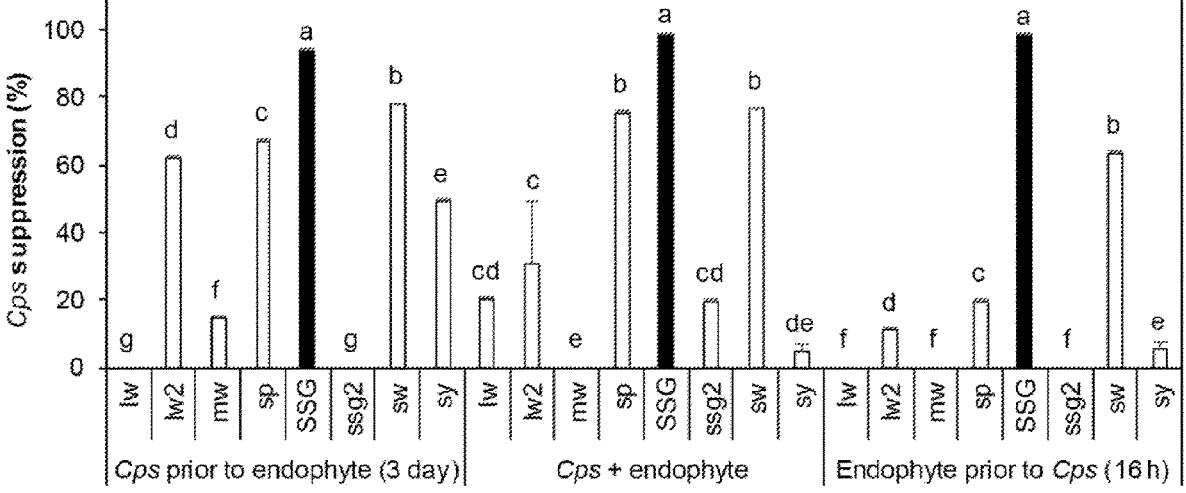
FIG. 14 shows reduction in colony diameter of 4 week old *Calonectria pseudonaviculata* (Cps) by SSG and other boxwood endophytes coded by size (s=small, m=medium, l=large) and color (p=pink, sg=sage green, w=white, y=yellow), plus a number if more than one isolate of similar color types and sizes assessed in three dual culture assays with slightly different Cps seeding timings in relation to bacterial streaking: 3 days before (left), at the same time (middle), and 16 h later (right). Each column represents a mean of triplicate plates, topped with a standard error bar. Columns topped with the same letter within each assay did not differ according to the LSD test at p=0.05.

The leaves showing symptom reversion were surface sterilized again with 70% ethanol, cut into small pieces, then vortexed in SDW for 10 min. When the leaf debris settled to the bottom, 100 μL of the supernatant was plated onto PDA then incubated at 25° C. for 48 h. Resultant bacterial colonies were grouped by color and size; eight representative colonies were subcultured on Difco nutrient agar (NA, Becton, Dickinson and Company, Sparks, MD, USA) for initial evaluation using a dual culture assay. Briefly, a mycelial plug of Cps was placed in the center of 90 mm PDA plates and a bacterial isolate from a 24 h liquid culture in Difco nutrient broth (NB, Becton, Dickinson and Company, Sparks, MD, USA) was streaked equidistantly on its left and right sides. Control plates were streaked with NB without the small sage green (SSG). The assay was done three times with slightly different timings of Cps seeding in relation to bacterial streaking: 3 days before in the first run, at the same time in the second run, and 16 h later in the third run. Each run included three replicate plates per bacterial isolate. All plates were incubated at 25° C. in the dark. The diameter of the Cps colony in each plate was measured 4 weeks later. The bacterial isolate that produced small sage green (SSG) colonies on PDA was consistently most effective against Cps growth (FIG. 14); subsequently, it was selected for further evaluation.

SSG Cell Suspension and Cell-Free Supernatant Preparation

SSG was maintained on PDA plates. For liquid culture, a 4 mL NB was inoculated with a single colony and incubated on a G24 Environmental Incubator Shaker (New Brunswick Scientific Inc., Edison, NJ, USA) at 180 rpm and 28° C. overnight, then used as a culture stock. For experiments, 150 mL NB or PDB was inoculated with 1 mL of the SSG stock then incubated for 40 h under the same conditions. The culture was centrifuged at 14,210×g for 15 min. Bacterial cells in pellets were resuspended in 200 mL PDB for in vitro assays or 0.01% polysorbate 20 for plant inoculation studies. Bacterial cell concentration of resultant resuspensions was determined by spreading 100 μL of its dilutions on PDA then counting the emerging colonies after a 2 day incubation at 25° C. The resultant bacterial cell concentrations ranged from $10^8$ to $10^9$ colony-forming units (cfu) per milliliter. In the meanwhile, the supernatant was further passed through a 0.22 μm filter to produce cell-free supernatant (CFS). Resuspended bacterial cells and CFS were evaluated separately for their potential against Cps unless stated otherwise. The resuspended bacterial cells and CFS treatments hereafter were referred to as Cell and CFS, respectively.

SSG Effect on Cps Conidia Survival and Germination

Three treatments, cell at $10^7$ cfu/mL, CFS, and PDB only as a control, were included in this study. A 100 μL aliquot of Cps suspension at $10^4$ conidia/mL SDW was mixed with 700 μL of Cell, CFS, or PDB in Costar™ 24 well Flat Bottom Cell Culture Plates (Corning Inc., Corning, NY, USA). The mixtures were incubated at 25° C. in the dark for 1, 4, 8, 24, or 48 h then examined for conidia lysis, germination, and germling differentiation using an Olympus IX71 inverted microscope (Olympus Corporation of the Americas Headquarters, Center Valley, PA, USA) at magnification of 100×. This assay included triplicate wells per treatment and was done twice.

Effect of SSG on Boxwood Blight

Four treatments were included in this study: (1) Cell at $10^8$ cfu/mL 0.01% polysorbate 20, (2) CFS, (3) 0.01% polysorbate 20 (as the control for the Cell treatment), and (4) NB (as the control for CFS). Boxwood foliage was pretreated at 20 mL/plant using hand sprayers one day prior to being challenged with Cps. This experiment had triplicate plants per treatment and was done three times. Treated plants were arranged in a randomized complete block design in the storage boxes for inoculation with Cps at 1 to $5\times10^4$ conidia/mL 0.01% polysorbate 20 at 20 mL/pot. Inoculated plants were kept in closed storage boxes for 48 h to facilitate infection. Diseased leaves and healthy-looking leaves on each plant were counted 7 days post inoculation. Disease incidence was calculated by dividing the diseased leaf count by the total leaf count.

Effect of SSG Concentration on Boxwood Blight

Five concentrations of 0, $10^3$, $10^5$, $10^7$ and $10^9$ cfu/mL 0.01% polysorbate 20 were included in the initial run. Based on the results from the initial run, the concentration of $10^3$ cfu/mL was excluded from the second run. Plant pretreatment including the lead time of one day, Cps inoculation, and disease assessment all were performed as described above with two minor changes. Cps inoculum concentration was at $5\times10^4$ and $2\times10^4$ conidia/mL in the initial and repeated runs, respectively. Likewise, the highest SSG cell concentration was slightly greater in the first than the second runs ($3\times10^9$ vs. $2\times10^9$ cfu/mL).

Effect of SSG Treatment Lead Time on Boxwood Blight

All boxwood plants were treated with SSG at $4\times10^8$ cfu/mL or 0.01% polysorbate 20 as control. A quarter of the plants pretreated with SSG and those with polysorbate 20 were inoculated with Cps at $2\times10^4$ conidia/mL 1, 10, 20, and 30 days later. SSG pretreatment, Cps inoculation, and disease assessment were all performed as described above for the SSG concentration experiment. Blight control was calculated for each lead time by dividing the difference in disease incidence between SSG treated and control plants by that of the control plants. This experiment was repeated once with SSG at $2\times10^9$ cells/mL and Cps at $10^4$ conidia/mL.

Effect of Post-Inoculation SSG Treatment on Boxwood Blight

This study included the application of resuspended SSG cells at three-time points: 3, 24, and 48 h post inoculation, plus a nontreated control. Cps inoculation, SSG treatment, disease assessment, and blight control calculations were done as described above for the lead-time experiment. The experiment was conducted twice with SSG at $5\times10^8$ cfu/mL and $4\times10^8$ cfu/mL while Cps was at $5\times10^4$ conidia/mL and $2\times10^4$ conidia/mL in the first and second runs, respectively.

SSG Effect on Potential of Diseased Leaves as a Source of Inoculum

This study began with collecting and air-drying diseased leaves then storing them in a cold room at 4° C. for 15 months. One hundred stored leaves were spread on the surface of the potting mix under healthy Justin Brouwers plants in a container, then immediately cover sprayed (not onto the boxwood foliage) with a mixture of 35 mL NB culture of SSG and 35 mL SDW at a final concentration of $10^8$ cfu/mL or 1 strength NB without SSG. Each treatment included three replicate plant containers and treatments were arranged in a randomized complete block design. After 24 h, plants in treated containers were overhead watered using a watering can, which was repeated every other day until the end of the experiment. To prevent cross contamination between treatments through movement of accumulated water at the bottom of boxes, plant containers were placed on inverted empty containers. Three sets of data were collected with Cps sporulation on leaf litter and blight incidence on boxwood foliage assessed six times while SSG survival in the potting mix was determined twice post-treatment. This experiment was conducted twice.

Cps ability to sporulate on control and SSG-treated leaf litter was assessed at 5, 10, 20, 30, 40, and 50 days post-treatment. On each assessment day, ten leaves were collected from each pot and placed onto mesh overlaid moist paper towels in closed plastic crispers for 5 days. These leaves were placed in a test tube with 10 mL 0.01% polysorbate 20 then vortexed for 10 min to dislodge conidia. Concentrations of conidia in resultant suspension were determined with a hemocytometer, and six independent counts were averaged for each replicate sample. The per ml conidia concentration was equivalent to the number of conidia produced per leaf. This number was then divided by Justin Brouwers average leaf size of 2 $cm^2$ to calculate the number of conidia produced per unit leaf area.

Blighted leaves including those fallen ones were counted for each plant. The total number of leaves on each plant was estimated by counting the number of branches then multiplying by a factor of 26 leaves per branch, which was predetermined based on the branch and leaf counts for plants in randomly selected 24 pots. Disease incidence was determined by dividing the diseased leaf count by total leaf estimate.

To determine SSG survival in soilless potting mix, a 100 mg sample was taken from the top 2 cm in each container using a straw. Each potting mix sample was added to a test tube with 10 mL SDW then vortexed for 15 min. After diluting 10 to $10^6$ times, 100 µL of original prep or a dilution was spread onto a PDA plate after the debris settled. Small sage green colonies were counted after a 72 h incubation at 25° C. Their SSG identity was verified with *Burkholderia cepacia* selective agar (BCSA, LabGenome, Houston, TX, USA).

SSG Species Identity and Differentiation from Epidemic Strains of *Burkholderia cepacia*

Three major steps were taken to determine SSG species identity. First, SSG was streaked onto BCSA medium and incubated at 25, 35, and 42° C. for 72 h to determine whether it belongs to the Bcc. Second, DNA was extracted from SSG cells, then 16S rRNA and RecA genes were amplified by PCR using the universal primers 27F, 968F, and 1410R, and primers BCR1 and 2, respectively. PCR products were sequenced at Eton Bioscience (Research Triangle Park, Raleigh, NC, USA). Processed sequences were deposited into GenBank (Accession: MK424809 for RecA gene and MK418913 for 16S DNA) and blasted against existing sequences in the NCBI repository and at EzBioCloud to determine the identity of this bacterial endophyte. Third, RecA PCR products were digested with HaeIII and MnlI then their RFLP were analyzed as described previously to determine their genomovar association in the Bcc.

Two additional steps were taken to assess SSG risk as a human health hazard. First, bacterial DNA was amplified with specific primers for the Bcc epidemic strain marker (BCESM) to determine whether this endophyte is associated with any known opportunistic human pathogens in the complex. Second, an onion maceration assay was conducted to differentiate SSG from clinical strains that generally do not macerate onion bulb scale tissue. Briefly, pieces of fresh onion scales were wounded with a sterilized needle and inoculated with 10 µL of 40 h SSG culture at $10^8$ cells/mL or NB as the control. The inoculated onion scales were incubated at 25° C. in a moist container, and symptom development of onion scale tissue was recorded after 3 days.

Data Analysis

Data from different experimental runs, if homogenous, were pooled then subjected to analysis of variance (ANOVA) to determine the level of difference among treatments and that of interactions among factors using Statistical Analysis Software version 9.4 (SAS Institute, Cary, NC, USA). Otherwise, they were analyzed by an experimental run. Treatment means were separated according to the least significant difference (LSD) test at p=0.05.

Example 6: Results and Discussion for Potent *Burkholderia* Endophyte Against Boxwood Blight Caused by *Calonectria pseudonaviculata*

SSG Effect on Cps Conidia Survival and Germination

Figure 8:
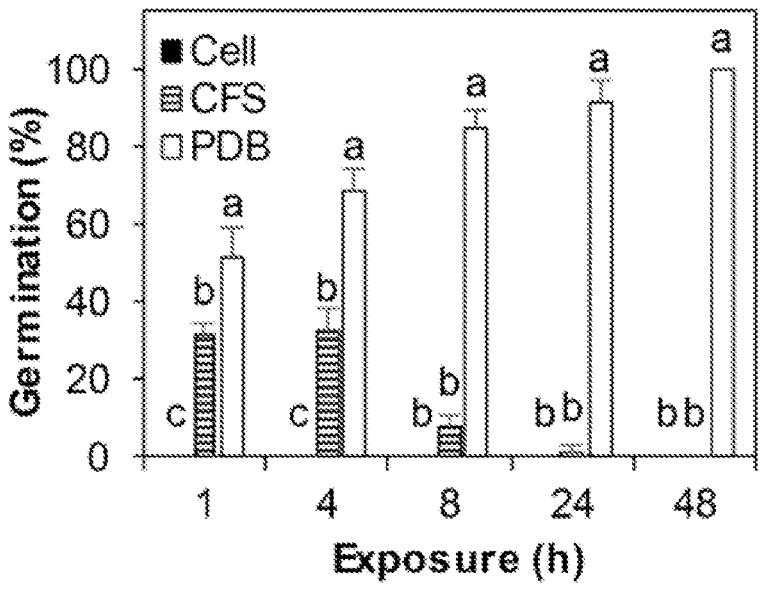
FIG. 8 shows conidia germination of *Calonectria pseudonaviculata* after being incubated in small sage green (SSG) cell suspension at $10^7$ cfu/mL (Cell), cell-free supernatant (CFS), or potato dextrose broth (PDB). Each column is an average of six replicates from two repeated assays and is topped by a standard error bar. Columns marked with the same letter within each exposure time did not differ according to the least significant difference (LSD) test at p=0.05.
Figure 9:
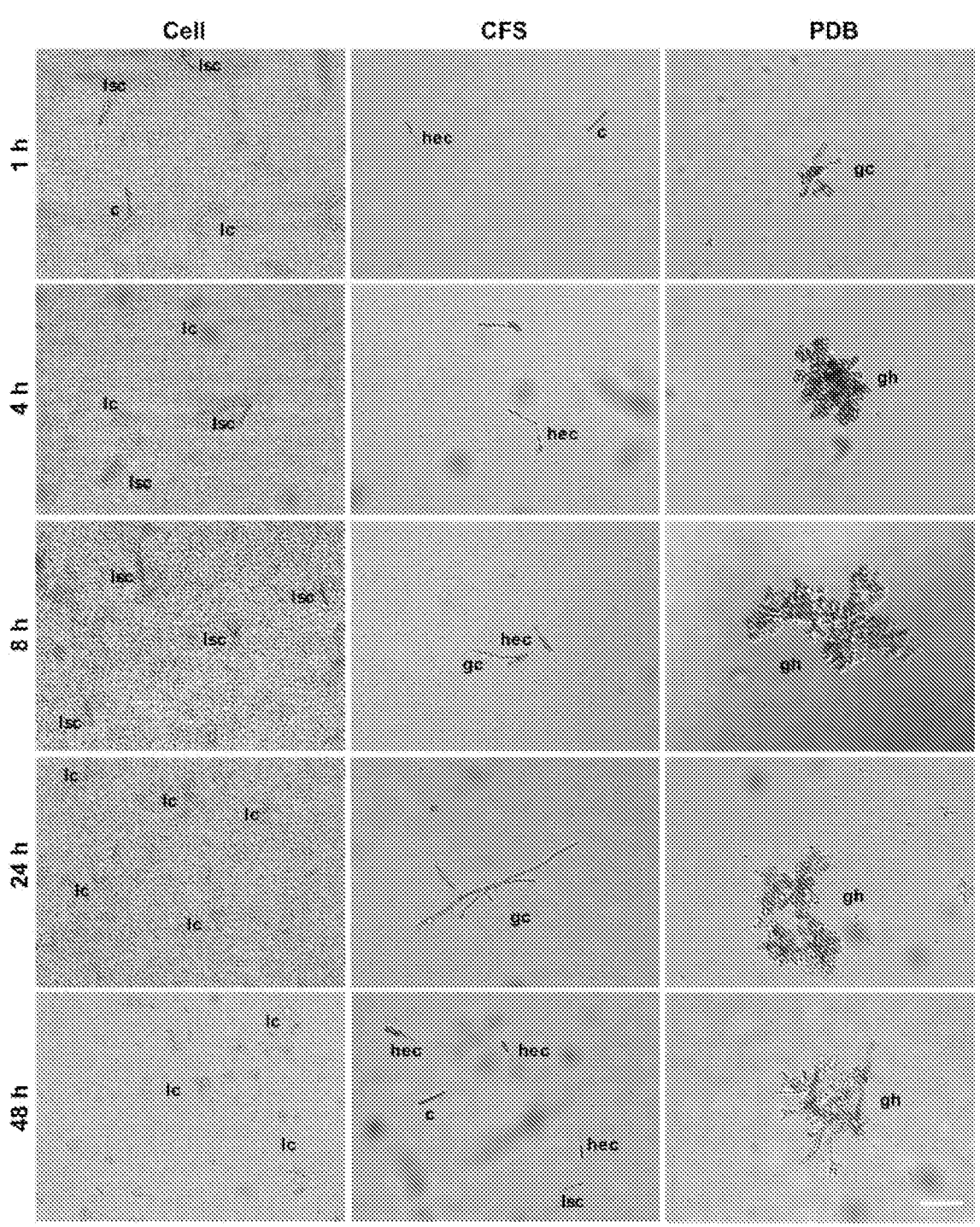
FIG. 9 shows micrographs of conidia morphology of *Calonectria pseudonaviculata* after being incubated in SSG cell suspension at $10^7$ cfu/mL (Cell), cell-free supernatant (CFS), or potato dextrose broth (PDB): c=conidium, lsc=lysing conidium, lc=lysed conidium, hec=half empty conidium, gc=germinating conidium, gh=growing hyphae from conidial germling. Bar=50 μm.

Difference was observed in germination of conidia among Cell, CFS, and PDB treatments (p<0.01), but not between the two experimental runs (p=0.19) nor among the exposure times (p=0.23). There were, however, significant interactions between treatment and exposure time (p<0.01). About 52% of conidia in control wells with PDB germinated within 1 h; their germination rate increased with time, reaching 100% at 48 h (FIG. 8) with germling aggregation and further development into hyphae (FIG. 9). In contrast, conidia germinated at a much lower rate in wells with CFS than those in control wells. None of the conidia in wells with SSG cells germinated over the 48-h period; in fact, they were all lysed. Similar conidial lysis was observed in wells with CFS, but to a lesser extent. Conidia that had not been lysed had an empty cell, they germinated poorly, and fewer germlings developed further (FIG. 9).

Effect of SSG on Boxwood Blight

Substantial blight control was seen on 'Justin Brouwers' plants pretreated with resuspended SSG cells or CFS one day prior to inoculation with Cps. Resuspended SSG cells were consistently more effective than CFS for blight control in all experiments (p<0.01). The former reduced blight incidence by nearly 100% when compared to the control with 0.01% polysorbate 20. Comparatively, CFS reduced blight incidence by 73% when compared to the control with NB. No difference in blight control among three experimental runs (p=0.31) nor any interaction between experiment run and treatment (p=0.35) was observed.

Effect of SSG Concentration on Boxwood Blight

Greater blight severity was observed (p<0.01) on control plants in initial than repeated experiments (98% vs. 33% leaves blighted) due to the difference in Cps inoculum concentration between the two runs ($5 \times 10^4$ vs. $2 \times 10^4$ conidia/mL).

Figure 10:
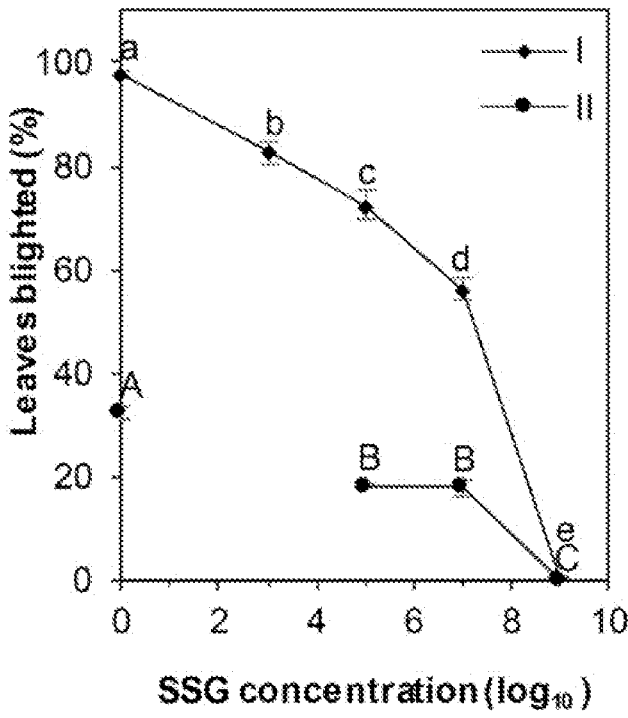
FIG. 10 shows leaf blight incidence on *Buxus sempervirens* 'Justin Brouwers' boxwood decreased with increasing SSG concentration from 0 to $10^9$ cfu/mL applied one day prior to inoculation with *Calonectria pseudonaviculata* at $5 \times 10^4$ and $2 \times 10^4$ conidia/mL in the initial (I) and repeated experiments (II), respectively. Boxwood blight was assessed 7 days after inoculation. Data points represent mean leaves blighted (%) of three replicate plants and are presented with a standard error bar. Means marked with the same small case letter did not differ in the first run and those with the same uppercase letter did not differ in the repeated run according to the LSD test at p=0.05.

Blight incidence decreased (p<0.01) with increasing SSG cell concentration: 83% on boxwood pretreated with SSG at $3 \times 10^3$ cfu/mL and 1% on those at $3 \times 10^9$ cfu/mL in the initial experiment (FIG. 10). A similar decreasing trend was observed in the repeated experiment: 18% leaves blighted at $2 \times 10^5$ cfu/mL and 1/10 percent at $2 \times 10^9$ cfu/mL (FIG. 10).

Effect of SSG Treatment Lead Time on Boxwood Blight

Figure 11:
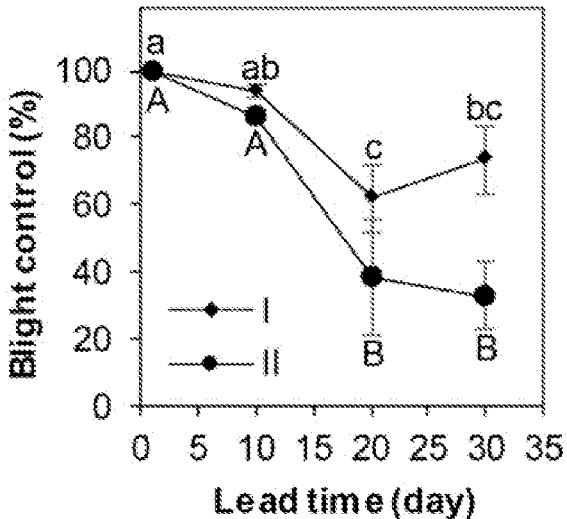
FIG. 11 shows blight control by SSG at $10^8$ cfu/mL decreased with increasing application lead time prior to inoculation with *Calonectria pseudonaviculata* at 1 to $2 \times 10^4$ conidia/mL. Each data point is a mean blight control of three replicate Justin Brouwers boxwood plants and is presented with a standard error bar. Means marked with the same small case letter did not differ in the first run and those with the same uppercase letter did not differ in the repeated run according to the LSD test at p=0.05.

When boxwood plants were cover sprayed with SSG at $4 \times 10^8$ cfu/mL prior to inoculation with Cps, significant differences were observed in blight control between two experimental runs (p=0.01) and four lead times (p<0.01). Blight control was over 99% in both runs when SSG was applied one day prior to inoculation with Cps, and the control efficacy decreased with increasing lead time (FIG. 11). Specifically, this decrease was significant between the lead times of 10 and 20 days, but not between 1 and 10 days, nor between 20 and 30 days in both runs.

Effect of Post-Inoculation SSG Treatment on Boxwood Blight

Figure 12:
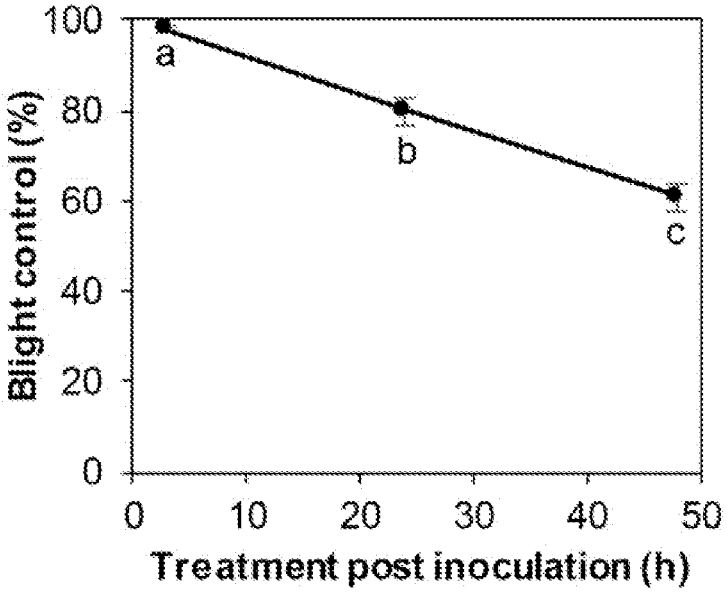
FIG. 12 shows blight control by SSG at $10^8$ cfu/mL decreased with increasing treatment time post inoculation with *Calonectria pseudonaviculata* at $10^4$ conidia/mL. Each data point is a mean blight control of six replicate Justin Brouwers boxwood plants from two experimental runs and is presented with a standard error bar. Data points marked with different letters differed according to the LSD test at p=0.05.

SSG applied 3 h post-inoculation reduced blight by 98% (FIG. 12). However, blight control decreased (p<0.01) with increasing time: 62% at 48 h post-inoculation. No difference was observed in blight control between two experimental runs (p=0.23).

SSG Effect on Potential of Diseased Leaves as a Source of Inoculum

Figure 13:
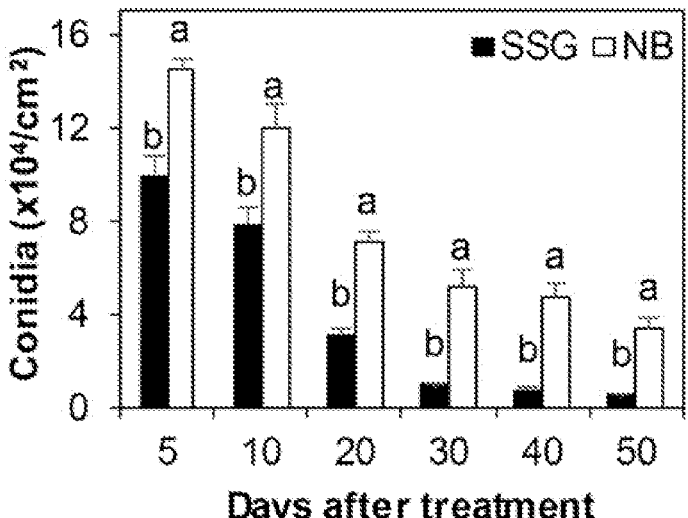
FIG. 13 shows SSG reduced sporulation by *Calonectria pseudonaviculata* on blighted leaves for a range of time after they were placed under healthy plants then cover sprayed with SSG suspension at $10^8$ cells/mL (SSG) or with nutrient broth (NB) as a control. Each column depicts an average of six replicates from two experimental runs and is topped with a standard error bar. Columns marked with different letters within each sampling time differed according to the LSD test at p=0.05.

More conidia were produced consistently on diseased leaf litter cover sprayed with NB than that treated with NB culture containing both SSG cells and metabolites in experiments (p<0.01, FIG. 13). Conidia production of both treatments decreased steadily with increasing post-treatment time (p<0.01). The number of conidia produced on NB-treated leaf litter was 144,542/cm$^2$ and 33,888/cm$^2$ at 5 and 50 days post-treatment, respectively. Likewise, the number of conidia produced on SSG-treated leaf litter was 98,756/cm$^2$ and 5,231/cm$^2$ at 5 and 50 days post-treatment, respectively.

Conidia produced on the leaf litter resulted in boxwood blight on the lower portion of Justin Brouwers plants. However, a higher percentage of leaves developed blight symptoms from the control litter cover sprayed with NB than those treated with SSG (11% vs. 1%, p<0.01). Difference was not observed in blight incidence between two experimental runs (p=0.25) nor among six assessment dates (p=0.70).

SSG population in sampled potting mix declined over the 50 day period (p<0.01) with 6×10$^9$ and 2×10$^6$ cfu/g at the beginning and termination of the study, respectively. The variety and population of other microbes recovered along with SSG also declined during the same period, and this decline was most obvious for fungi. SSG was never detected in control potting mix treated with NB.

SSG Species Identity and Differentiation from Epidemic Strains of *Burkholderia cepacia*

Several lines of evidence supported SSG's membership in the Bcc, although it does not seem to belong to any known species. It grew well in *B. cepacia* selective agar at 25° C. and 37° C., but not 42° C. Its 16S rDNA sequence also was 99% identical to many known species in the Bcc with *B. cepacia* JCM 2799 and *Burkholderia* sp. JJOA-S as the closest match when being blasted through NCBI and EzBio-Cloud, respectively. Likewise, its RecA gene sequence had the best alignment with that of *B. cepacia* strain IST431. When SSG RecA PCR products were digested with HaeIII and MnlI restriction enzymes, they produced a RFLP pattern that was similar to type "H" of genomovar III and type "d" of genomovar I, respectively. This result indicated that SSG belonged to neither genomovar I nor III because the expected RFLP pattern for genomovar I was "D" with HaeIII digestion, and for genomovar III was "g" with Mn/I digestion.

Figure 15:
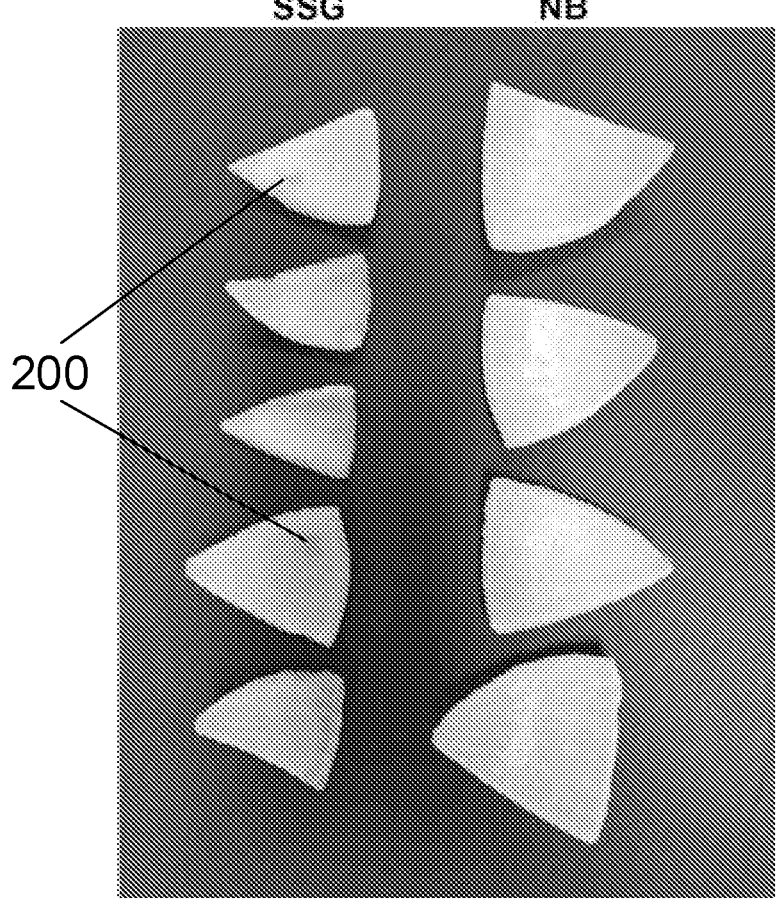
FIG. 15 shows symptoms on onion scales at 3 days after inoculation with a 10 µL drop of 48 h culture of SSG or nutrient broth (NB) control.

Both ID and RFLP indicated that SSG was distinct from all known clinical strains in the Bcc. In addition, SSG DNA was not amplified with the *B. cepacia* epidemic strain marker. Furthermore, unlike clinical strains, SSG macerated onion scale tissues (FIG. 15).

DISCUSSION

This study identified a potent *Burkholderia* endophyte, SSG, with both protective and curative properties against boxwood blight. As a protectant, SSG at 10$^8$ cfu/mL applied one day prior to inoculation with Cps provided almost complete protection of Justin Brouwers boxwood, a highly susceptible cultivar under high disease pressure environments (FIG. 11). This blight control efficacy is comparable to those of the most effective fungicides. In fact, it performed much better than the most effective biofungicides and all biocontrol agents identified to date, including Root-Shield Plus, non-indigenous isolates of *Trichoderma koningiopsis*, and *Pseudomonas protegens*, as well as an indigenous strain of *Pseudomonas lactis*. As a curative agent, SSG reduced blight by 98% when its cell suspension at 10$^8$ cfu/mL was applied 3 h after inoculation with Cps (FIG. 12).

In addition to directly protecting boxwood plants from infection by Cps, SSG greatly affected other major steps in the boxwood blight disease cycle. First, fallen diseased leaves are important sources of inoculum for new infection. SSG reduced the pathogen's ability to produce conidia on diseased leaf litter by 32% at 5 days after cover spray treatment; this reduction rate increased with time: 85% at 40 days and longer (FIG. 13). Second, conidia are the major dispersal and infective structure for boxwood blight. SSG at 10$^7$ cfu/mL completely lysed conidia while CFS had a similar but lesser impact. Together, SSG is an effective biological sanitizer and may be used to reduce the pathogen population at sites of infestation.

SSG may involve complex modes of action against Cps. First, some environmental Bcc species are known to produce unique antifungal antibiotics such as pyrrolnitrin, occidiofungin, and glidobactins. SSG may produce these antibiotics for suppression of Cps mycelial growth, although their species and mechanisms are yet to be elucidated. Second, SSG may also produce chitinases and glucanases that break down the cell wall building blocks, including chitin, glucans, and other polymers during the lysis process. The fact that conidia were lysed at a much greater rate in wells with live bacterial cells than those with CFS supports this hypothesis. Further studies on the molecular interactions between SSG and Cps are warranted to understand the modes of action by which SSG acts against Cps. It is worth noting that when Cps and SSG were grown in different sections of multisection Petri plates, no suppression was observed. Thus, the involvement of volatile compounds by SSG in Cps suppression is unlikely.

Many endophytes can elicit plant resistance during plant infection, and more than likely, SSG is able to do the same in boxwood against boxwood blight. This hypothesis is supported by the fact that boxwood plants remained moderately protected from infection by Cps even 20 days and longer after SSG treatment (FIG. 11). SSG may have elicited plant defenses that provide persistent resistance to the disease, although at low to moderate levels. Bcc bacteria survive poorly on leaf surfaces. The sustained blight control by SSG in the present study may also be due in part to their entry into plant tissue at a low rate that may continually act against Cps. Further study on the interaction between plant and SSG is warranted to elucidate the mechanisms underlying the sustained blight control.

Bcc is a very diverse *Burkholderia* group including some opportunistic human pathogens that are associated with lung infection in patients with cystic fibrosis. Although SSG belongs to Bcc, its profiles do not match with those of any known species in this complex and its likelihood of being a human pathogen is low. First, SSG was tested negative for BCESM, the standard human virulence marker used by the United States Environmental Protection Agency for registration of biocontrol products with Bcc as an active ingredient. With reference to FIG. 15, SSG macerated 200 fresh onion scales, a phenomenon not observed for known clinical strains. Additionally, SSG was isolated from surface-sterilized plant tissue whereas all clinical strains were isolated from human tissue or waste.

Although SSG may protect boxwood from infection by Cps for 3 to 4 weeks, longer than most fungicides currently labeled for protecting boxwood and/or controlling Cylindrocladium diseases, its efficacy decreased with time (FIG. 11). This reduction in SSG efficacy with time may be due in part to a declining bacterial population. Therefore, the second question of practical importance is how SSG interacts with boxwood and how its survival inside and on the surface of boxwood foliage may be improved for sustained high blight control performance. Formulation and delivery methods could have tremendous impacts on the performance of microbial biocontrol agents. So, an additional question is how SSG may be formulated and delivered to enhance its entry and survival inside and on the surface of boxwood plants for sustained survival and blight control performance. Nevertheless, this study identified a highly potent biocontrol agent with protectant, curative, and sanitizing properties.
Example 7: SSG Genome SSG genome DNA was extracted from overnight cultures in nutrient broth (BD, Sparks, MD) at 28° C. using Nucleo-Spin® Microbial DNA-Macherey Nagel (TaKaRa Bio, Bethlehem, PA) and quantified using Quantus™ Fluorometer (Promega, Madison, WI). Sequencing was performed on a MinION device (Oxford Nanopore Technologies, Oxford, United Kingdom). The sequencing library was prepared with the ligation sequencing kit (SQK-LSK109) according to the manufacturer's instructions and run in a FLO-MIN106 (R9.4.1) flow cell. Sequence basecalling was performed using MinKnow (Oxford Nanopore, Oxford, United Kingdom) at Q Score of 11 and run option of Fast5 for 20 h. Fastq files with a total of 9.46 Gb bases from 1.19 million reads that passed the Q score were used for de novo genome assembly using Canu version 1.8 with the default parameters for Nanopore data. After read correction and trimming, the final assembly from the retained single largest high-quality chunk of sequences resulted in a sequence with a total length of 8,571,737 bp and an average GC content of 66.9% arranged in six contigs. The genome coverage is 108.64-fold (N50=5,470,797) (Table 2). The assembly was annotated using Prokka 1.14.1 and Rast 2.0. Prokka predicted 9039 protein-coding sequences (CDS) and 76 tRNA, nine rRNA and one tmRNA. Rast predicted 10209 CDS, 67 tRNAs, 18 rRNAs and one tmRNA.

TABLE 2

| Genome Features of *Burkholderia* sp. SSG | |
|---|---|
| Feature | Value |
| Genome size (bp) | 8,571,737 |
| GC content (%) | 66.9 |
| Secondary metabolism gene clusters | 866 |
| Coding sequence | 10209 |
| tRNA | 67 |
| rRNA | 18 |
| tmRNA (transfer messenger RNA) | 1 |

Eight hundred and sixty-six secondary metabolism gene clusters were detected through Rast analysis. 15 gene clusters related to antibiotic biosynthesis were detected with antiSMASH 5, which included genes for nonribosomal peptide synthetase (NRPS), polyketide synthase (PKS), pyrrolnitrinis and bacteriocin production (Table 3). These clusters accounted for 6% of the genome assembly. This genome capacity for antibiotic biosynthesis is more than twice that of other analyzed Bcc species. This feature of SSG is consistent to its potent antagonism we observed on oomycete, some bacterial and fungal pathogens. Interestingly, except for gene cluster for biosynthesis of terpene that has been used for pesticide (Table 3), through Prokka and Rast annotation, we identified genes for production of insecticidal photopexin and presqualene diphosphate synthase (hpnD).

TABLE 3

| Predicted Secondary Metabolite Clusters Involving Antibiotic Biosynthesis | | | | | | |
|---|---|---|---|---|---|---|
| Cluster | Number | Contig | Average size (bp) | % in the genome | Examples | Potential Applications |
| Non-ribosomal peptide synthetase (NRPS) | 3 | 1 & 6 | 52601 | 1.84 | Pyochelin, ornibactin | Cytotoxic antibodies |
| Polyketide synthase (PKS) | 2 | 1 | 46054 | 1.07 | Polyketide, myxochromide D, capsular polysaccharide | Antibiotic, anticancer agents |
| tRNA-dependent cyclodipeptide synthases (CDPS) | 1 | 79 | 22042 | 0.26 | Cyclodipeptide | Antifungal, antiviral (influenza A), anti-multidrug resistant bacterial, and anticancer agents |
| Terpene synthase | 5 | 1, 19, 79 | 21463 | 1.25 | Terpene | Pesticides |
| Aryl polyene | 1 | 19 | 41210 | 0.48 | Polyene | Antioxidants, antibiotics |
| Bacteriocin | 1 | 79 | 10758 | 0.13 | Protein TolQ, Colicin V synthase | Antibacterial drug |
| Phosphonate | 1 | 1 | 40578 | 0.47 | Phosphinothricin tripeptide | Antifungal and anti-oomycete agent |

TABLE 3-continued

| Predicted Secondary Metabolite Clusters Involving Antibiotic Biosynthesis | | | | | |
|---|---|---|---|---|---|
| Cluster | Number | Contig | Average size (bp) | % in the genome | Examples | Potential Applications |
| Other | 1 | 79 | 41082 | 0.48 | Pyrrolnitrin | Antibacterial, antifungal, and anti-oomycete agent |

Many genes involving plant growth promoting traits were also identified through manual annotation (Table 4). These included genes for nitrogen fixation including a nitrogenase gene (eg. NifQ) and a hgIE cluster or heterocyst glycolipid synthase-like PKS involving nitrogen fixation in cyanobacteria heterocyst as well as other genes for nitrogen fixation and regulation including pstN and glnB. There were also genes for phosphate solubilization (glucose dehydrogenase and pyrroloquinoline quinone (PQQ)) synthesis proteins for organic acid production, siderophore production for iron binding and transfer as well as genes for plant growth hormone production or modulation such as auxin biosynthase and ethylene metabolism.

TABLE 4

| Predicted Genes/Products Involving Plant Growth Promotion Traits (PGPT) | | | | | |
|---|---|---|---|---|---|
| Gene/product | Number of genes (>) | Example | Contig | PGP trait | Potential application |
| Coenzyme pyrroloquinoline quinone (PQQ) | 5 | pqqB, C, D, E | 1, 79 | Plant defense, production of glucose dehydrogenases (GDHs) | Plant stress resistant elicitor, gluconic acid production, antioxidant, antineuroinflammatory drug production |
| Hydrogen cyanide synthase | 6 | HcnB, C | 1 | Regulating availability of phosphate | Biofertilizer |
| Proteins in butanediol metabolic process | 2 | BudC | 2, 19 | Plant defense | Plant resistant elicitor |
| Nitrogen metabolism and transport | 4 | gdh, glnB, ptsN | 19, 89 | Regulating nitrogen utilization | Biofertilizer |
| Urea degradation | 20 | ureA-I, allA, alc, pucl | 1, 19, 79 | Regulating nitrogen utilization | Biofertilizer |
| 1-aminocyclopropane-1-carboxylate deaminase (ACC) | 1 | acdS | 1 | Reducing plant ethylene levels | Plant growth regulator |
| Tryptophan synthase | 2 | trpA, B | 1 | Auxin production | Plant growth regulator |
| Biotin biosynthesis and transport | 9 | accB, C, BioB, C, D, madC | 1, 2, 6, 19 | Seed development | Plant seed production |
| Gluconic acid production | 5 | GDHs, gdhl, IV | 1, 19, 79 | Phosphate solubilization | Biofertilizer |
| Siderophore biosynthesis, transport and liberation of iron | 102 | yusV, TonB | All 6 | Iron uptake, phosphate solubilization by production of chelating substance | Plant growth regulator |

These results supported SSG as a possible potent biocontrol agent for plant diseases. They also indicated that SSG may also be a candidate biocontrol agent for insect pests and a biofertilizer.

SSG was identified as *B. cepacia* through genome-based identification on TrueBac™ ID. The average nucleotide identity (ANI) between the genomes and the type strain of *B. cepacia* was 98.4%. (ANI coverage of 94.8%). However, multilocus sequence typing (MLST) of the SSG genome sequence revealed that SSG contains only three of the seven loci that are used for differentiation of species in the Bcc.

Although SSG had the same allele number at atpD as two strains of Bcc (BCC0412, IST431) and the same allele number at lep as one strain (BCC0218) of Bcc in genomovar I, the overall SSG allelic profile did not match any Bcc that has been listed previously, indicating divergence of SSG from other species in this genomovar that uses *B. cepacia* as a representative.

Clinically important isolates of Bcc are most commonly members of genomovars II and III, with few human pathogens contained within genomovar I. To determine if SSG was different from clinical strains, we searched for the cable pilin gene encoding *Burkholderia cepacia* epidemic strain marker (BCESM) in the predicted CDS by Prokka and Rast. We did not find any CDS for the gene, indicating an absence of BCESM, which is consistent with PCR results in a previous study. Together with the presence of genes involving in nitrogen fixation that is a missing trait in clinical Bcc strains, SSG is a unique member of the Bcc which is distinct from clinical strains and appears to have great promise for agriculture and biotechnology applications.

Example 8: Materials and Methods for Characterization of Boxwood Endophytic *Burkholderia cepacia* SSG as a Plant Growth Promoter Isolate and Culture

*Burkholderia* sp. SSG isolate was deposited at the Virginia Tech Collection of *Phytophthora* and Beneficial Microbes (VTC) of the World Data Center for Microorganism (WDCM1197). SSG was grown on potato dextrose agar (PDA or nutrient agar (NA) or in nutrient broth (NB) (Becton, Dickinson and Company, Spark, MO, USA) for 48 h at 25-28° C. The culture was maintained at 4° C. within a month after growth and stored at −80° C.

IAA Production

IAA production by SSG was determined quantitatively using a published colorimetric method with a minor change. A single colony of SSG on a streak plate was transferred into four milliliters of NB containing four milligrams of tryptophan. After a 72-h incubation at 28° C., 1.5 mL SSG broth culture and NB without SSG as control was centrifuged at 13,523×g for five minutes, 0.5 ml of the supernatant was then mixed with one milliliter of Salkowski's reagent in a 1.5-mL tube. The mixtures were incubated at 23° C. for 30 min, then measured for absorbance at 530 nm after blanked with the control on Du®800 spectrophotometer (Beckman Coulter, Indianapolis, IN, USA). The assay was run in triplicate and repeated once. The result was quantified using a standard curve of known IAA dilution series (Sigma-Aldrich, St. Louis, MO, USA) at a range of 0.1 to 300 μg mL-1.

Nitrogen Fixation Ability

The nitrogen fixation ability of SSG was determined by growing SSG on nitrogen-free agar medium. Specifically, nitrogen-free agar plates were streaked with fresh SSG colonies on a PDA plate. Meanwhile nutrient agar plates as source of nitrogen were also streaked as positive control. After a four-day incubation at 25° C., the plates were examined for bacterial growth. The assay was conducted in triplicate and repeated once.

Phosphate Solubilization

The ability of SSG to solubilize phosphate was determined using the National Botanical Research Institute's Phosphate (NBRIP) medium broth or plate and colorimetric method with minor modifications. For the plate assay, three sterilized Whatman filter paper disks were placed as an equilateral triangle in NBRIP agar plates. A 10-μL aliquot of SSG cell culture stock was added to each disk. Control disks received the same amount of nutrient broth without SSG. All plates were examined for the development of halo around the disks after incubated at 27° C. for seven days. For the broth colorimetric assay, 150 mg $Ca_3(PO_4)_2$ as an insoluble form of phosphate was included in a 30 mL NBRIP broth. In the broth, 0.3 mL of overnight SSG culture in NB or NB alone was added. After incubated on a shaker at 27° C. for seven days, the broth was centrifuged at 13416×g for 10 min. The supernatant was autoclaved for 20 min and stored at 4° C. To determine soluble phosphate release into the solution, one milliliter of the supernatant or its dilution of samples was added with two milliliters of 2.5% ammonium molybdate and 0.5 ml of 10 M sulfuric acid, then mixed with one milliliter of 0.5 M hydrazine hydrate solution and filled with SDW to 25 mL. The resultant solutions were blanked with the supernatant of the control and measured for the absorbance at 840 nm on the spectrophotometer (Beckman Coulter, Indianapolis, IN, USA). When the absorbance of a sample was one or smaller, soluble phosphate in the sample was calculated with the formulation: sample absorbance/0.1235+0.0018. When the absorbance of a sample was one or greater, it was calculated with diluted samples. Both assays included three replicates and were repeated once.

Siderophore Production

Siderophore production by SSG was determined using a blue agar medium containing chrome azurol S (CAS) and the indicator hexadecyltrimethylammonium bromide. Specifically, the media plates were streaked with SSG and incubated at 25° C. Plate color change was examined after 48 h. Plates with a color change from blue to yellow were recorded as positive. This assay included three replicate plates, and the assay was repeated twice.

Plant Treatment and Growth Measurement

Three boxwood cultivars of different growth rates, *Buxus sempervirens* 'Justin Brouwers' (slow), 'Buddy' (intermedium) and *B. microphylla* var. *japonica* 'Winter Gem' (fast) were used in this study. These cultivars with two plants were grown in 3.8-l containers and maintained in a greenhouse before use. One week before SSG treatment in November 2018, plants were pulled out containers, separated and weighed after the potting mix was removed and plants were rinsed with tap water. Weighted individual plants were repotted with a mixture of Scotts® Premium Potting Soil (Marysville, OH) and pine barks (Pacific Mulch Inc, Henderson, NC) at ⅓ to ⅔ ratio in 3.8-L containers. These plants were watered manually to saturate the soil after potting, then drip-irrigated every other day for one min.

Plants were inoculated by drenching SSG cell suspension. To prepare SSG cell suspension, 150 mL of NB was inoculated in a flask with one milliliter of the stock, an overnight culture of SSG in NB, and incubated at 28° C. on a shaker for 40 h. Three flasks of the culture were used for an experiment. The culture was centrifuged at 8,275×g for 15 min to precipitate cells that were resuspended in 500 mL Phosphate-Buffered Saline (PBS) (pH=7.4) after supernatant was removed. A 50-mL aliquot of SSG resuspension at $10^8$ cfu/mL or the same amount of PBS was evenly poured onto the potting mix around plants in a container. After treatment, containers were arranged in a randomized complete block design and dripping irrigation was resumed for plants in two days. In March 2019, plants were moved from the green house to a gravel pad outside where they were overhead irrigated. In September 2019, plants were pulled out again and weighted after root cleaning as done at the beginning of the experiment in November 2018. The monthly growth rate was calculated by dividing the difference in plant weight between measurements at the beginning and end of the experiments by 10 for each replicate of cultivar and treatment combination. The experiment was conducted three times.

Statistical Analysis

Plant growth data from three repeated experiments were subjected to homogeneity test and subsequently pooled for further analyses. Analysis of variance was conducted using the Statistical Analysis Software Version 9.4 (SAS Institute, Cary, NC). Treatment means were separated by boxwood cultivar according to the least significant difference at P=0.05.

Figures 17A, 17B, 17C, 17D, 17E, 17F, 17G, 17H:
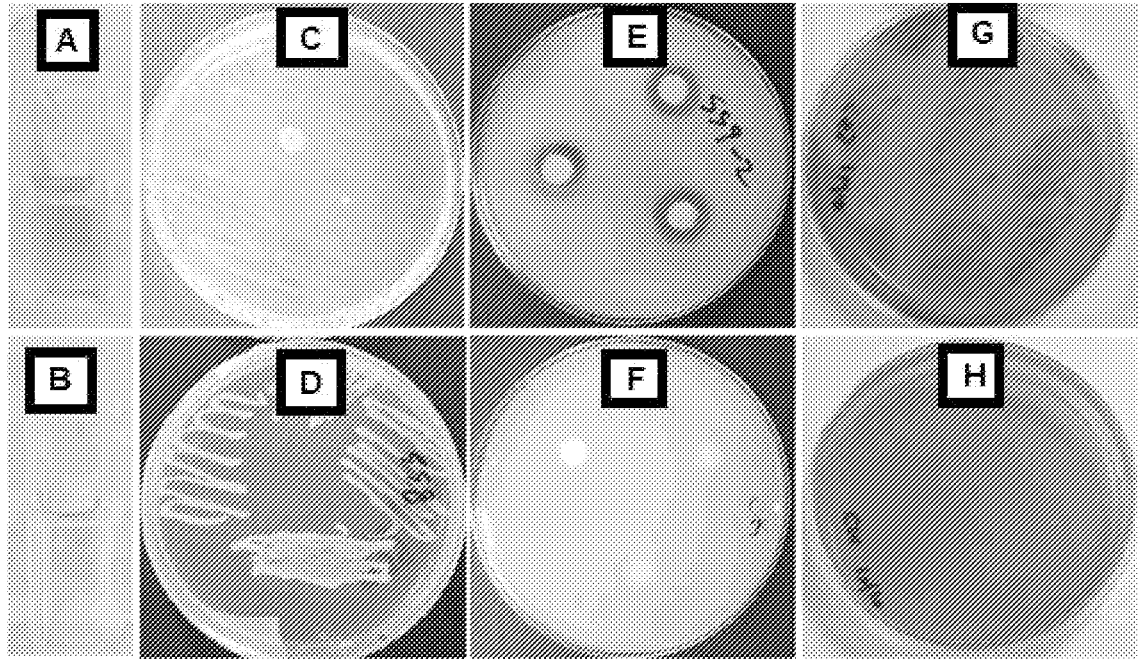
FIGS. 17A-17H show SSG plant growth-promoting traits as shown in a colorimetric or plate assay.

Example 9: Results and Discussion for Characterization of Boxwood Endophytic *Burkholderia cepacia* SSG as a Plant Growth Promoter Indole-3-Acetic Acid (IAA) Production IAA was detected in the cell-free supernatant of SSG culture two days after NB broth containing tryptophan was inoculated (FIGS. 17A, 17B). The estimated yield was 2.9-4.5 µg/mL that had no change with increasing growth time. No color change was observed in the same medium that was not inoculated with SSG. These results indicated that SSG was able to produce IAA. It is not clear whether this IAA yield of SSG is common in IAA producing *Burkholderia* due to lack of quantitative data for other *Burkholderia*. However, it is relatively low compared to some non-*Burkholderia* bacterial endophytes that produce 9.6-43 µg IAA/mL. Surprisingly, genes encoding tryptophan-2-monooxygeanse or tryptophan transaminase were not found in the SSG genome despite that there are genes for tryptophan production. These enzymes play important roles in the pathways of tryptophan-dependent IAA biosynthesis in bacteria (*Pseudomonas* and *Agrobacterium*) and plants. SSG producing IAA in the experiment without these genes suggests that this bacterium may use a different pathway from those currently known, which remains to be investigated.

IAA is the basic and most potent auxin natively occurring and functioning in plants and it regulates leaf and flower development. SSG is the first IAA-producing burkholderial bacterium from boxwood leaves based on our knowledge, while other IAA-producing *Burkholderia* are found in stem, root, and rhizosphere. SSG can survive in soil, indicating that it may also be a rhizosphere endophyte. This bacterium might have been as a boxwood symbiont facilitating the growth of plants, although whether and how SSG may move in the plant deserve a further investigation.

Nitrogen Fixation

SSG grew on the N-free medium, indicating its ability to fix atmospheric nitrogen (FIGS. 17C, 17D). This trait is expected as the SSG genome contains a nitrogenase gene (eg. NifQ) and a hgIE cluster, heterocyst glycolipid synthase-like PKS involving nitrogen fixation in cyanobacteria heterocyst, as well as other genes for nitrogen fixation and regulation such as pstN and glnB. Nitrogen fixation has been found in various endophytic bacteria although it is not common for Bcc. As a new nitrogen-fixing member of Bcc following B. vietinamiensis, SSG may be a great resource of boxwood plants in nitrogen acquisition and metabolism.

Phosphate Solubilization

Phosphate solubilization of SSG was evaluated using milky NBRIP agar media (FIGS. 17E, 17F). Around disks with SSG there was a clear halo initially seen on the third day of placing the disk. The halo enlarged with increasing incubation time. On day seven, the halo was evident and had diameter 14 mm (±0.3). No halo was present in any control plate without SSG. Weak phosphate-solubilizing bacteria do not display halo in the plate assay. The halo formulation with SSG suggests that the bacterium is a potent phosphate solubilizer. The solubilized phosphate was 206.4 ppm (±5.0) as estimated on the seventh day after treatment using a colorimetric method by which solubilization of $Ca_3(PO_4)_2$ in the broth remained detectable after the sample was diluted 100-fold. This amount was about four percent of the insoluble form of phosphate, which is slightly lower than that of other reported strong phosphate solubilizing bacterial endophytes, including *Burkholderia* spp. This difference among bacteria may have resulted from quantification methods used for insoluble phosphate. In this study we used the colorimetric method instead of the optical density of the broth. Phosphate-solubilizing bacteria can improve crop yield when used to inoculate seed or soil due to the release of insoluble and fixed forms of phosphorus. As a member of these bacteria, SSG is a great phosphorus resource for plants.

Siderophore Production

Siderophores from microorganisms can be used by the plant as an iron nutrient source, alleviating the stresses imposed on plants by high levels of heavy metals in soil and plant pathogen suppression. SSG was a strong siderophore producer, as indicated by decolorating blue chrome azurol S agar 48 h after the plate was streaked with SSG (FIGS. 17G, 17H). No color change occurred in control plates. This is supported by SSG genome sequencing showing that there are more than 100 genes or copies involving in siderophore biosynthesis, assembly and metabolism. However, further studies are warranted to understand how these siderophores may be used for plant growth promotion.

Effect of SSG as Inoculant on Boxwood Plant Growth

Figure 18:
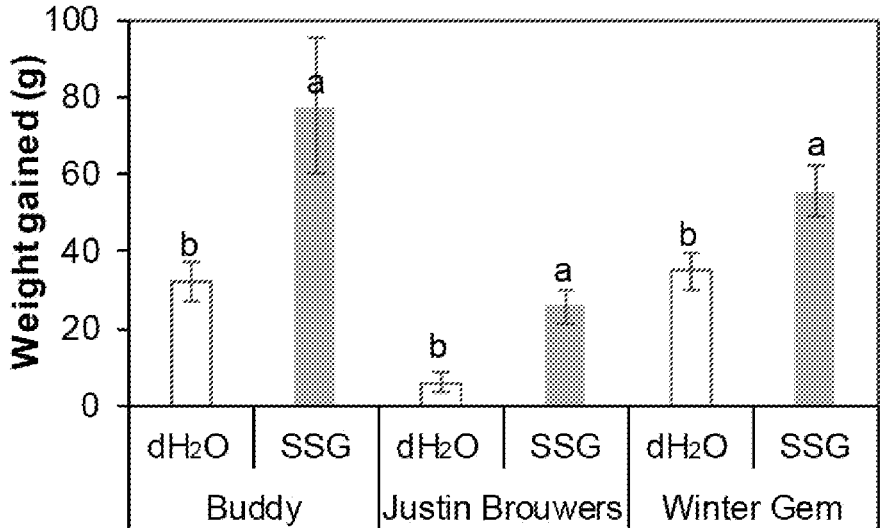
FIG. 18 shows boxwood plant growth of three cultivars-Buddy (intermediate), Justin Brouwers (slow) and Winter Gem (fast) as affected by SSG cell suspension (SSG) or control (dH$_2$O) drench over a 10-month period. Each column is a mean of 9 replicate plants from three repeated experiments. Standard error bars are presented on top of the columns. Columns within each cultivar topped with different letters differed according to the least significant difference at P=0.05.

SSG was used to inoculate boxwood roots to evaluate whether it may stimulate plant growth over a 10-month period. Plant growth showed no difference between three repeated experiments (P=0.6905) nor interaction between cultivar and treatment (P=0.2121), cultivar and experiment (P=0.1366) and between treatment and experiment (P=0.2434). However, there was significant difference between SSG inoculated and uninoculated treatments, although the difference varied with cultivar (P<0.0001). SSG consistently promoted plant growth of all three boxwood cultivars when compared to PBS. Specifically, SSG resulted in an increase of monthly growth rate that is 58%, 76%, and 37% greater than that of the control in Buddy (P=0.0236), Justin Brouwers (P=0.0014), and Winer Gem (P=0.0190), respectively. Leaf number increase has been observed for boxwood Justin Brouwers in containers with diseased leaf debris that was sprayed with SSG culture in a previous study of boxwood blight control with SSG. In that study, it was not certain whether the leaf increase resulted from plant growth or disease reduction. This study confirmed SSG as a plant growth bacterium contributing to the new growth of leaves. Justin Brouwers is a slow growth boxwood cultivar while Buddy and Winter Gem are medium and fast growth cultivars, respectively. SSG appeared more effective on promoting slow and medium growth plants than fast growth plants (FIG. 18). This study demonstrated the ability of SSG to produce IAA and siderophore, fix nitrogen and solubilize phosphorus as predicted by the genome sequencing. These features, together with its other features such as potent antagonism against pathogens and low human health risk may allow SSG to become a prospective biocontrol agent and PGPB in agriculture.

Example 10: Materials and Methods for *Burkholderia cepacia* SSG as a Broad-Spectrum Antagonist for Suppression of Multiple Plant Diseases Microorganisms and their Growth Conditions Except for SSG and tomato spotted wilt virus, information of other microbes used in this study were listed in Tables 5 and 6. Potato dextrose broth (PDB), nutrient broth (NB) (Sigma-Aldrich, St. Louis, MO, USA), or 5% clarified V8 medium broth (V8B) and their agar plates were used for culture and growth of fungi, bacteria, and oomycetes, respectively at 23-28° C. depending on the experiment.

Dual Culture Assay

Dual-culture assays were performed differently on agar medium plates depending on target microorganisms. For fungi and oomycetes, a 0.45 cm diameter plug of a week-old agar culture was placed in the center of a PDA plate between two streaks of SSG overnight broth culture or two streaks of NB medium as the control. Diameters of the targets were measured 1-4 weeks after the plates were incubated at 25° C. For target bacteria, 100 μL of overnight culture in NB were spread on NA plates, and three sterilized disks (0.7 cm in diameter) of Whatman filter paper No. 1 were placed at three angles of an equilateral triangle in the center of the plates, and each was dropped with 10 μL SSG cell culture stock or NB as the control. Diameters of suppression halo zone from the disks were measured 72 h after the treatment at 25° C. For each target isolate/strain, three replicate plates were included. Each assay was repeated at least twice.

Phytophthora Zoospore Germination Suppression by SSG

While germination suppression of fungal conidia by SSG has been reported, this study focused on zoospore germination suppression. P. capsici was used for easy zoospore production as described previously. 100 μL of zoospore suspension at $10^5$/mL was added into 1 mL PDB containing 50 μL SSG cell suspension at $10^7$ cfu/mL, SSG culture cell-free supernatant (CFS) or the control PDB alone in a well of 6-well plates. Four replicate wells were used for each treatment and examined for morphological changes of zoospores under a microscope 24 and 48 h after the addition of zoospores. The assay was repeated once.

Plants and Growth Conditions

Eleven plant species/cultivars were used for disease suppression experiments with SSG. They were started from seed, seedlings or grown plants at Hampton Roads Agricultural Research and Extension Center (HRAREC). Experimental plants were watered with a drip or overhead irrigation programmed for best growth of plants and maintained greenhouse or gravel pad at HRAREC before use.

Annual vinca (Catharanthus roseus 'Little Bright Eye') and pepper (Capsicum annuum L. 'California Wonder') plants were started from seeds as described previously. Plants were grown in the greenhouse for 4-8 weeks before use after transplantation with 2-3 seedlings per pot with dimensions of 15.9×14.7 cm.

Two-year Fraser fir (Abies fraseri) seedlings and 6-8-week seedling plugs of garden pansy (Viola tricolor var. hortensis), geranium (Pelargonium 'American White'), impatiens (Impatiens walleriana 'Beacon Orange'), and petunia (Petunia×hybrida 'Wave® Misty Lilac Hybrid') were purchased from nurseries. All the seedlings were transplanted, grown in pots with dimensions of 15.9×14.7 cm and used after 6-8 weeks.

Potting mix used for transplanting contained 89% unamended aged pine bark (Pacific Organics, Henderson, NC, USA), 10% Metro-Mix 830 (Sungro Horticulture, MA, USA), 0.59% 16-6-11, 5-6 month-controlled release fertilizer (CRF) (Harrell's, Lakeland, FL, USA), 0.06% Nitroform (Agrium Advanced Technologies, ON, Canada), 0.27% Pro Pulverized Limestone and 0.14% Pro Granular Limestone (Oldcastle Lawn & Garden, PA, USA) for a pH at 6.5-7.

Boxwood 'Green velvet' (B. sempervirens×B. microphylla var. koreana), hydrangea (Hydrangea paniculata 'Limelight'), and rhododendron (Rhododendron catawbiense 'Boursault') plants were gifts grown in pots with dimensions of 15.9×16.5 cm, 25.4×22.9 cm and 15.9×16.5 cm, respectively. Hydrangea plants were pruned back to promote new growth and fertilized with CRF two months before use. All plants were watered with a drip or overhead irrigation and maintained in the greenhouse or grovel pad at HRAREC before use.

Inoculum Preparation

Overnight broth culture SSG was used as a stock to make an inoculum for a plant treatment before or after inoculation with a pathogen. 350 mL NB was added to 1 mL of the stock and shaken for 40 h at 28° C. to get culture at a concentration range of $10^8$ cfu/mL as described in a previous study. The control was NB or sterile distilled water (SDW) depending on the suspension used.

Foliage inocula of Phytophthora including P. capsici, P. nicotianae, and P. ramorum were prepared with zoospores produced as described previously, respectively. P. nicotianae used for root inoculum was isolates from petunia (30J5 and 31A3). Concentrations of zoospore suspensions were adjusted with soil water extract to one at a range of $10^4$ zoospores/mL. Inoculum of P. cinnamomi used three isolates (28D5, 28E3, 28E6) from Fraser fir was made with 25 g double autoclaved Mahatma long grain rice soaked 18 mL $dH_2O$ in a 250-mL flask. The rice was inoculated with four agar culture plugs and incubated at 23° C. The inoculum was ready in about 10 days, during which the flask was tapped daily to redistribute grains until grains became powdery white.

Inocula of fungi including Collectortrichum fruticola, C. gleosporiodes, Botrytis cinerea, and Volutella buxi were prepared with conidia produced from 10 to 14 days old PDA cultures. Concentrations of conidial suspensions were adjusted with 0.01% polysorbate 20 to a range of $10^{5-6}$ conidia/mL.

Inoculum of Xanthomonas campastris was prepared from 3-day culture of the bacteria at 30° C. on PDA plates. At inoculation, the culture was resuspended in 0.01% polysorbate 20 to have a concentration of $8×10^7$ cfu/mL determined with a previously described platting method used for SSG.

Infected tomato plants with typical symptoms of tomato spotted wilt in a vegetable garden at HRAREC were used as inoculum source of TSWV for impatiens natural inoculation. Prior to inoculation, a pathogenicity test was conducted using a symptomized leaf sap. Specifically, the collected diseased leaf was cut and ground in a small volume of 0.01 M phosphate buffer at pH 7.0 with carborundum (Fisher Scientific, NJ, USA). The 10-fold diluted sap and sap from healthy leaves as the control were used to gently rub impatiens leaves. Plants inoculated with the sap from diseased plant showed necrotic spots after a few days, indicating diseased tomato plants could be used as an effective inoculum source.

Plant Treatment with SSG

For foliage treatment with SSG, plants were placed in moist chambers and applied with the inoculum or the control with a hand sprayer until dripping before or after inoculated with a pathogen inoculum, lead times for pretreatment with SSG before inoculation included one day (1 db), one week (1wb), two (2wb) or four weeks (4wb). Post-time treatment with SSG after inoculation with a pathogen was 3 days (3da). For each treatment, 3 replicate pots were included. Treated plants were removed from the moist chamber the next day and overhead irrigation was resumed on the third day after treatment.

For root treatment, each Fraser fir or petunia plant in a pot was drenched with 50 mL SSG inoculum or NB. Each treatment pot containing 3 replicate plants. Irrigation remained the same after treatment.

Plant Inoculation with a Pathogen

Pathogen inoculation was conducted at one day, one week, two weeks, or 4 weeks after the treatment or three days before the treatment. Prior to inoculation, SSG treated and control plants were arranged with a randomized block design. For foliage inoculation with a fungus or Phytoph-

*thora*, the inoculation was conducted with a hand sprayer as did for SSG. For inoculation with *X. campestris*, plant leaves were injured with push pins, five pinches per leaf, and then sprayed with the bacterial inoculum. Inoculated plants were kept in a moist chamber for 48 h before placed in a shade area with mist or hand watering until disease rating.

Inoculation of root pathogens used two methods. For P. cinnomomi, it was done with rice grain inocula. Four grains were placed in a hole at each of three plants in a pot. For *P. nicotianae*, it was done by drenching 5 mL inocula around the crown of each plant. Overhead irrigation was not disrupted before plants were rated for diseases. Natural inoculation (*thrips*) was conducted for TSWV. SSG treated or control *impatiens* plants were placed in a place surrounded by diseased tomato plants in the vegetable garden where 30 min/day overhead irrigation was carried out.

After a week of exposure, plants were moved back to the gravel pad with regular irrigation. Plants were assessed 10-20 days after inoculation for disease severity with a 1-10 scale: 1=1-10%, 2=11-20% up to 10=91-100% infection of plants or plant parts. Each experiment was repeated at least once.

Data Analysis

Data from each experiment and phytopathosystem were analyzed using the Microsoft Excel 2010 data function. Statistics used standard analysis of variance (ANOVA) Two-Factor with Replication or t-Test assuming equal variance at a (significant level)=0.05. Standard errors were calculated for all mean values based on standard divination (StdDevp) and replicate.

Example 11: Results and Discussion for *Burkholderia cepacia* SSG as a Broad-Spectrum Antagonist for Suppression of Multiple Plant Diseases SSG Inhibits Culture Growth of Three Groups of Pathogens SSG was cross cultured with three groups of microorganisms, bacteria, fungi and *Phytophthora*. Except for *E. coli*, all of the test isolates were from plants. SSG significantly inhibited growth of nine fungal, six oomycete and five of six bacterial species tested (Table 5).

TABLE 5

| | Suppression of Microorganisms by SSG in a Dual Culture Assay | | | | | | |
|---|---|---|---|---|---|---|
| Group | Species | Isolate | Source | Suppression[x] | SE[y] | P Value[z] |
| Bacteria | *Escherichia coli* | DH52 | ATCC | 12 | 0.7 | <0.0001 |
| | *Erwinia carotovora* | 60624 | Iris | 0 | 0 | 1 |
| | *Pseudomonas syringae* | 60625 | Tomato | 22 | 1.0 | <0.0001 |
| | *Raistonia solanacearum* | 60626 | Tomato | 4 | 0.2 | <0.0001 |
| | *Stenotrophomonas maltophilia* | SY (PE1) | Boxwood | 21 | 0.5 | <0.0001 |
| | *Xanthomonas campestris* | 60627 | Begonia | 28 | 0.3 | <0.0001 |
| Fungi | *Alternaria tenuissium* | PC2 | Pansy | 73.7 | 1.1 | <0.0001 |
| | *Botrytis cinerea* | PC4 | Pansy | 53.9 | 1.4 | 0.0001 |
| | *Collectortrichum acutatum* | Imp2 | Impatiens | 70.8 | 0.6 | 0.0002 |
| | *C. frutticola* | PS5 | Pansy | 68.5 | 1.1 | 0.0007 |
| | *C. gleosporiodes* | Hyd1 | Hydrangea | 64.3 | 1.0 | 0.0014 |
| | *C. viniferum* | Imp1 | Impatiens | 63.3 | 0.9 | 0.0013 |
| | *Fusarium proliferatum* | Carl | Carnation | 69.9 | 1.0 | 0.0001 |
| | *F. solani* | 11b07 | Sweet box | 83.7 | 0.7 | <0.0001 |
| | *Volutella buxi* | 11A10 | Boxwood | 87.7 | 1.9 | <0.0001 |
| Phytophthora | *P. capsica* | 22H3 | Pumpkin | 80.9 | 0.8 | 0.0001 |
| | *P. cinnamomi* | 30D6 | *Ilex glabra* | 74.6 | 2.2 | 0.0002 |
| | *P. infestans* | 27E7 | Tomato | 94.4 | 0 | 0 |
| | *P. nicotianae* | 1B11 | Annual vinca | 81.5 | 1.8 | 0.0002 |
| | *P. ramorum* | 32G2 | Camellia | 91.3 | 0.5 | <0.0001 |
| | *P. sojae* | 28G4 | Soybean | 81.6 | 1.3 | <0.0001 |

[x]Suppression of bacteria is indicated by halo diameter (mm) around disk with SSG. Suppression of fungi and *Phytophthora* by SSG is indicated by percentage of inhibited culture growth compared to the control 4 weeks after the cross.

[y]is the standard error of 9 replicates in 3 assays.

[z]results from t = test at $\alpha$ = 0.05.

Figure 16A:
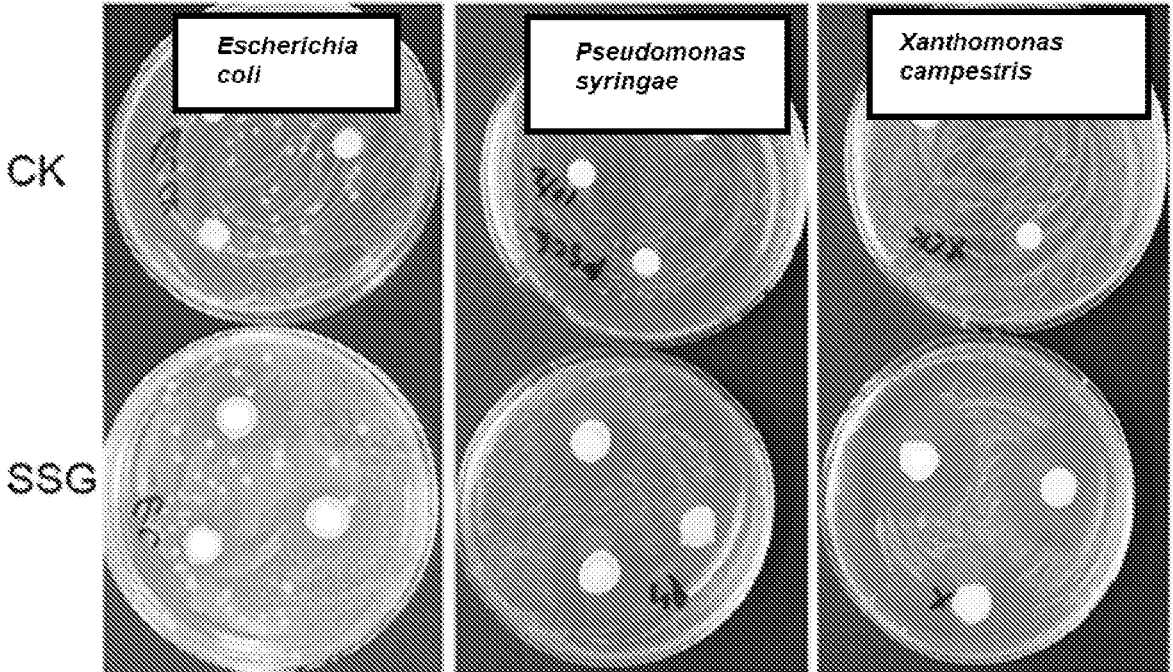
FIGS. 16A-16C show dual culture assays of microbial culture suppression by SSG at 25° C. Pictures were taken for bacteria (FIG. 16A) at 3rd day and for fungi (FIG. 16B) and *Phytophthora* (FIG. 16C) at 28th day except for *B. cinera, C. acutatum,* and *C. gloeosporioides,* which were at 7th day after setup of the assays.
Figure 16B:
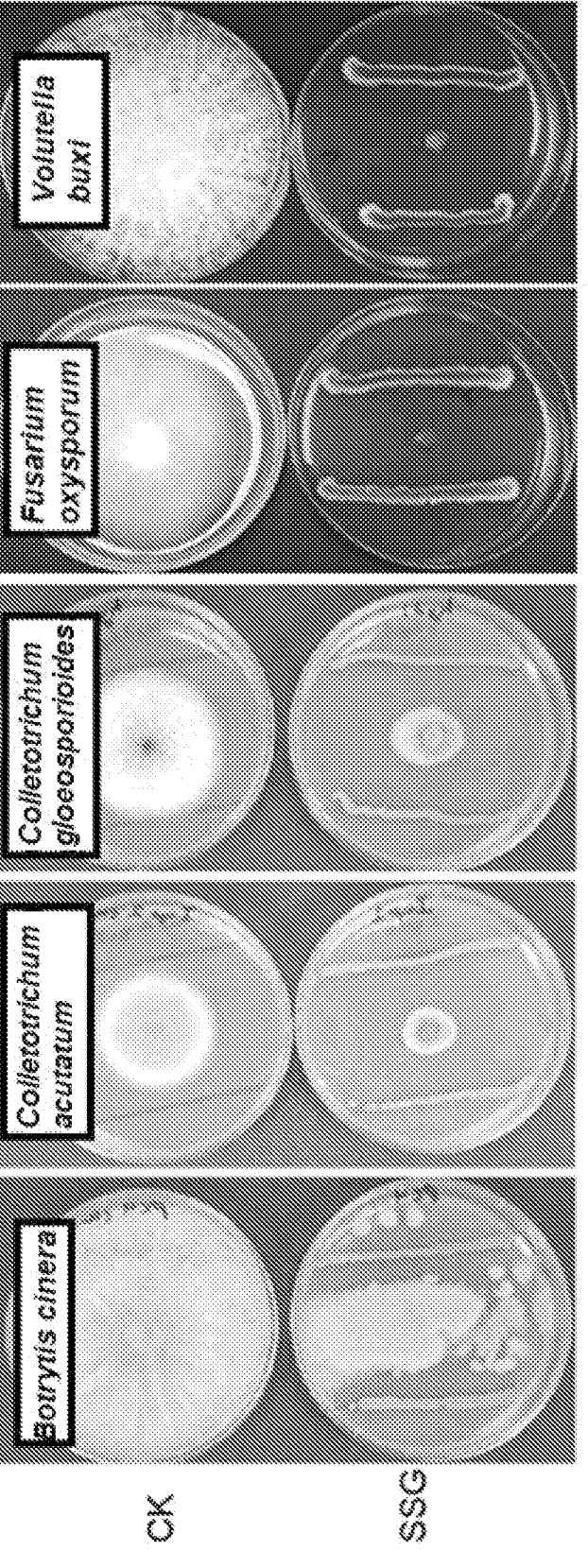
Figure 16C:
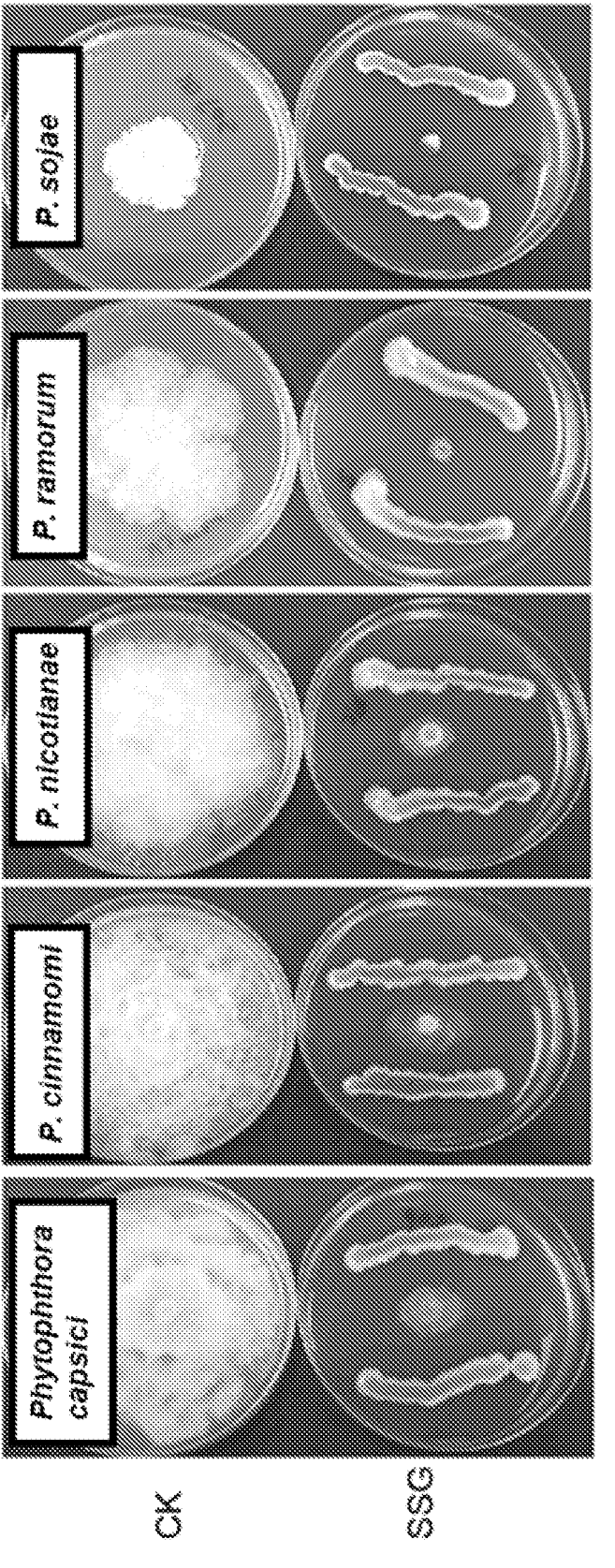

Between filamentous fungi and *Phytophthora*, stronger suppression was observed on *Phytophthora* than on fungi (FIG. 16). Among tested *Phytophthora*, the growth of *P. infestans* and *P. ramorum* was reduced by more than 90%. The growth of the rest was reduced by at least 75% compared to the control. For fungi, suppression rates were lower, between 54 to 88% (Table 6).

TABLE 6

Plant Disease Suppression by SSG

| Phytopathosystem | Treatment | Disease Severity (1-10 scale)[x] | | | | | | | | | |
|---|---|---|---|---|---|---|---|---|---|---|---|
| | | 1dbi | | 1wbi | | 2wbi | | 4wbi | | 3dai | |
| | | Mean | SE | Mean | SE | Mean | SE | Mean | SE | Mean | SE |
| Fraser fir | SSG | 2 | 1.4 | 3.2 | 0.8 | 1.8 | 1.0 | 2.8 | 1.5 | 2.5 | 1.3 |
| *P. cinnamomi* | CK | 3.7 | 1.8 | 2.5 | 0.7 | 2.3 | 1.2 | 2.8 | 1.2 | 3.1 | 1.2 |
| (28D5, 28E3, 28E6 mix) | P value (n = 4)[y] | *0.005* | | 0.26 | | *0.5* | | 1 | | *0.49* | |
| | Reduction (%)[z] | 45.9 | | −28 | | 21.7 | | 0 | | 19.4 | |
| Petunia | SSG | 1.5 | 1.3 | 1.7 | 1.9 | 1.7 | 1.1 | 7 | 1.5 | 5.2 | 1.7 |
| *P. nicotianae* | CK | 1 | 0.9 | 0 | 0.0 | 6.7 | 1.2 | 4.7 | 1.7 | 3.8 | 2.4 |
| (30J5, 31A3 mix) | P value (n = 3) | 0.74 | | 0.3 | | 0.007 | | 0.23 | | 0.59 | |
| | Reduction (%) | −50 | | 100 | | 74.6 | | −48.9 | | −36.8 | |
| Rhododendron | SSG | 1.8 | 0.2 | 2.3 | 0.1 | 5.3 | 0.3 | NA | NA | NA | NA |
| *P. ramorum* | CK | 3.9 | 0.3 | 5.3 | 0.3 | 7.3 | 0.3 | NA | NA | NA | NA |
| | P value (n = 9) | 0.0002 | | 0.033 | | 0.101 | | | | | |
| | Reduction (%) | 53.9 | | 56.6 | | 27.4 | | | | | |
| Annual vinca | SSG | 0.3 | 0.1 | NA | NA | NA | NA | NA | NA | NA | NA |
| *P. nicotianae* | CK | 6.3 | 0.7 | NA | NA | NA | NA | NA | NA | NA | NA |
| | P value (n = 9) | <0.0001 | | | | | | | | | |
| | Reduction (%) | 95.2 | | | | | | | | | |
| Bell pepper | SSG | 3.9 | 0.9 | NA | NA | NA | NA | NA | NA | NA | NA |
| *P. capsici* | CK | 8.9 | 0.6 | NA | NA | NA | NA | NA | NA | NA | NA |
| | P value (n = 9) | 0.0016 | | | | | | | | | |
| | Reduction (%) | 56.2 | | | | | | | | | |
| Hydrangea | SSG | 0.8 | 0.1 | 0.8 | 0.1 | 0.8 | 0.1 | 1.3 | 0.3 | 1 | 0.0 |
| *C. gleosporiodes* | CK | 2.4 | 0.4 | 2.3 | 0.3 | 1.4 | 0.1 | 2.3 | 0.3 | 1.4 | 0.1 |
| | P value (n = 9) | <0.0001 | | 0.001 | | 0.012 | | 0.08 | | 0.04 | |
| | Reduction (%) | 66.7 | | 65.2 | | 42.9 | | 43.5 | | 28.6 | |
| Pansy | SSG | 3.9 | 0.8 | NA | NA | 5.3 | 0.4 | NA | NA | 3.7 | 0.6 |
| *C. fruticola* | CK | 5.6 | 0.8 | NA | NA | 7.7 | 0.7 | NA | NA | 5.5 | 1.0 |
| | P value (n = 6) | 0.23 | | | | 0.041 | | | | 0.1 | |
| | Reduction (%) | 30.4 | | | | 31.2 | | | | 32.7 | |
| Pansy | SSG | 2.9 | 0.7 | NA | NA | NA | NA | NA | NA | NA | NA |
| *A. tenuissium* | CK | 7.3 | 0.8 | NA | NA | NA | NA | NA | NA | NA | NA |
| | P value (n = 9) | 0.002 | | | | | | | | | |
| | Reduction (%) | 60.3 | | | | | | | | | |
| Petunia | SSG | 6.3 | 0.5 | 1.4 | 0.2 | 5 | 0.4 | 5 | 0.7 | 4.9 | 0.3 |
| *B. cinerea* | CK | 7.9 | 0.6 | 4.2 | 0.3 | 7.4 | 0.7 | 7.9 | 0.5 | 8 | 0.3 |
| | P value (n = 9) | 0.07 | | <0.0001 | | *0.001* | | <0.0001 | | 0.02 | |
| | Reduction (%) | 20.3 | | 66.7 | | 32.4 | | 36.7 | | 38.8 | |
| Boxwood | SSG | 1.9 | 0.2 | NA | NA | NA | NA | NA | NA | NA | NA |
| *V. buxi* | CK | 3.4 | 0.4 | NA | NA | NA | NA | NA | NA | NA | NA |
| | P value (n = 9) | 0.014 | | | | | | | | | |
| | Reduction (%) | 44.1 | | | | | | | | | |
| Geranium | SSG | 1.4 | 0.1 | 1.6 | 0.1 | NA | NA | NA | NA | 1.7 | 0.1 |
| *X. campastris* | CK | 3.3 | 0.2 | 2.7 | 0.2 | NA | NA | NA | NA | 3.8 | 0.3 |
| | P value (n = 9) | 0.0002 | | 0.004 | | | | | | <0.0001 | |
| | Reduction (%) | 57.6 | | 40.7 | | | | | | 55.3 | |
| Impatiens | SSG | 2.6 | 0.3 | 3 | 0.1 | 1.9 | 0.2 | 4.2 | 0.0 | NA | NA |
| TWSV | CK | 3.2 | 0.2 | 4.1 | 0.3 | 4 | 0.3 | 3.2 | 0.0 | NA | NA |
| | P value (n = 9) | *0.003* | | 0.01 | | *<0.0001* | | 0.02 | | | |
| | Reduction (%) | 23.5 | | 26.8 | | 52.5 | | −31.3 | | | |

[x]Disease severity with a 1-10 scale: 1 = 1-10%, 2 = 11-20% up to 10 = 91-100% infection of plants or plant parts. 1dbi, 1wbi, 2wbi, and 4wbi represent treatments at 1 day and 1, 2, and 4 weeks before inoculation with a pathogen, respectively. 3dai represents a treatment at 3 days after inoculation with a pathogen.
[y]P results from two-factor ANOVA with replication at $\alpha = 0.05$. "n" is replicate plant pots from repeated experiments. Underlined numbers indicate a significant difference between CK and SSG. Italicized numbers indicate significant differences among experiments. Reduction is calculated using (CK-SSG)/CK × 100.
[z]NA = data is not available.

Specifically, fast-growing species such as *Botrytis cinerea* were less affected compared to slow-growing species.

Bacterial suppression by SSG depended on species. Suppression halo zones that were larger than 1.5 cm in diameter were observed for three species, *X. campestris*, *P. syringae*, and *S. maltophilia* (Table 5). SSG also strongly suppressed *E. coli* although the suppression was not as strong as for *X. campestris* and *P. syringae* (FIG. 16). However, it did not suppress *E. carotovora* and suppression of *R. solanacearum* was weak (Table 5).

Figure 5:
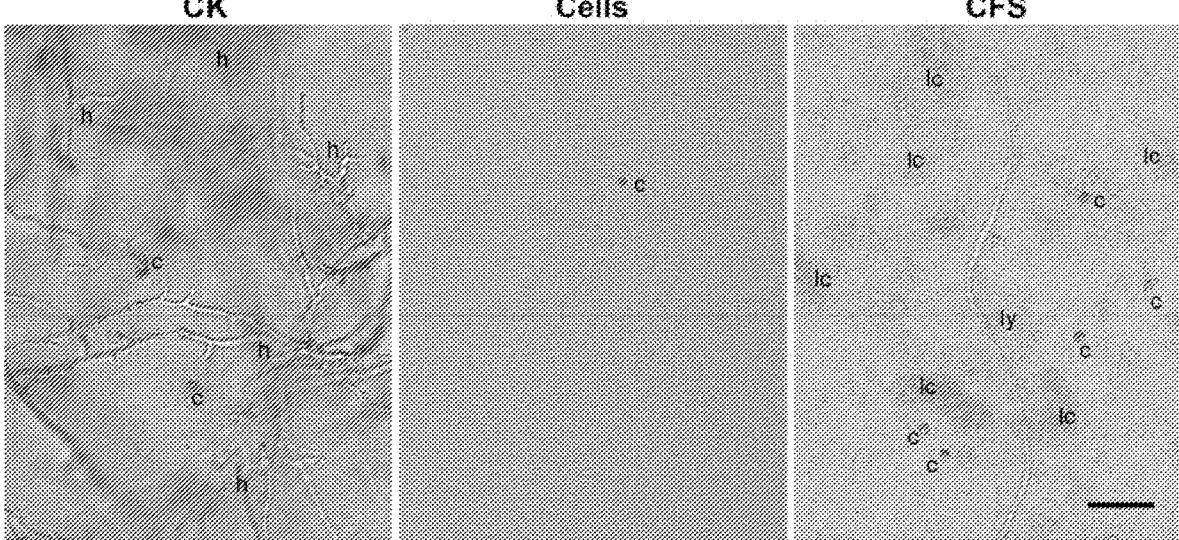
FIG. 5 shows effects of SSG on germination and survival of *P. capsici* zoospores at $10^4$/mL. Left: Zoospores in potato dextrose broth (PDB) without SSG (CK). Bar=50 μm. Center: Zoospores in cell-free suspension (CFS). Right. Zoospores in SSG cells resuspended in PDB. Micrographs were taken 24 h after incubation. c=conidium, ly=lysing conidium, lc=lysed conidium, h=hyphae.

The effects of SSG on culture growth of bacterial, fungal and oomycete pathogens indicate that SSG is a broad-spectrum antagonist. This conclusion is consistent with SSG great genomic capacity for antibiotic production estimated by genome sequencing. SSG contains not only synthase cluster of pyrrolnitrin, an antibiotic for fungi and strepto- mycetes and gram positive bacteria, but also gene clusters for bacteriocin production, polyketide synthase (PKS) and nonribosomal peptide synthetase (NRPS). The latter has been linked with synthesis of occidiofungins or burkholdi- nes, a new antibiotic effective against fungal pathogens and *Pythium*, a relative of *Phytophthora*. Activities of SSG in dual culture assays suggests that SSG is capable to produce such antibiotics and other beyond through diffusing in agar which can effectively inhibit growth of fungal, oomycete and some bacterial pathogens. Despite that SSG may pro- duce bacteriocin that may contribute to inhibition of five out of six test bacterial pathogens, it may not produce kasug- ammycin (kasumin), an effective bactericide for *Erwinia* sp due to the fact that *E. carotovora* was not suppressed in the dual culture assay. Efficacy of SSG on Gram positive bacterial pathogens remained unknown despite the fact that SSG can produce pyrrolnitrin effective on these pathogens.
Zoospore Lysis and Germination Inhibition As an important *Phytophthora* pathogen and large zoo- spore producer, P. capcisi was used for zoospore germination test. Almost all zoospores lysed 24 h after incubation with resuspended SSG cells while the control without SSG cells did not (FIG. 5). To determine whether the suppression was resulted from antibiotics produced, zoospores were also incubated with cell free supernatant of the SSG culture (CFS). Poor gemination of the zoospores as for treatment with SSG cell suspension was observed. However, in CFS treatment there were many fewer lysed cysts compared to that in SSG cells (FIG. 5), indicating that metabolites of SSG suppressed mainly germination but not lysis of zoospores. *P. capsici* zoospore lysis by *B. cepacia* metabolites has been reported previously. In that study, up to 10% zoospore lysis was observed within a one-hour time course which was significantly lower compared to a *Pseudomonas* isolate used. It is not clear whether SSG CFS may result in a different rate in the same time frame.

Similar effects of SSG have also been observed in spore lysis and germination of fungal boxwood blight pathogen Cps. Oomycetes and fungi are different in cell wall compo- sition. The former is composed of chitin, while the latter is made up of a mix of cellulosic compounds and glycan. To degrade cell wall degradation of these microorganisms, SSG must be a strong producer of lytic enzymes. Chitinase, $\beta \rightarrow 1,3$-glucanase, and proteases are common lytic enzymes found in bacterial and fungal biocontrol agents. Except for chitinase and $\beta \rightarrow 1,3$-glucanase, 58 genes encoding various proteases and five genes for biosynthesis of a-glucosidases and B-glucosidases that involve in cellulose degradation are present in the SSG genome. This suggests that SSG may use unusual mechanisms to lyse spores of fungi and *Phytoph- thora*.
Control of Plant Diseases by SSG SSG was evaluated in 12 phytophathosystems involving ornamental plants and their pathogens, including bacteria, fungi, oomycetes and a virus. Up to five treatment times before and after plants were inoculated with a pathogen were investigated. SSG gave a disease control efficacy varied from phytopathosystems, pathogen types, and treatment intervals (Table 6). The highest efficacy was in *vinca— Phytophthora nicotianae*. Spraying plants with SSG cell suspension at one day before pathogen inoculation (1dbi) resulted in 95% disease reduction. The same treatment also resulted in more than 50% disease reduction in other five systems, *rhododendron —P. ramorum*, pepper—P. capcisi, pansy—*Alternaria* tenuissium, *hydrangea*—Collectortri- chum gleosporiodes, and geranium—*Xanthomonas camp- estris*. Similar efficacy was also observed for treatments with an expanded interval, one week before inoculation (1wbi), in *rhododendron—P. ramorum* and *hydrangea*—C. gleospori- odes. However, decreased efficacies were observed at 2-4 wbi. For *rhododendron—P. ramorum*, the efficacy was 30% lower and for *hydrangea*—Collectortrichum gleosporiodes, it was 20% lower. Performances of SSG in these systems are similar to that observed in boxwood-Cps, which suggests that SSG may use mechanisms mediated by direct antago- nism or mixed-path antagonism. Plants treated with SSG and nutrient broth (CK) are shown in FIGS. 7A-7D.

Figure 7A:
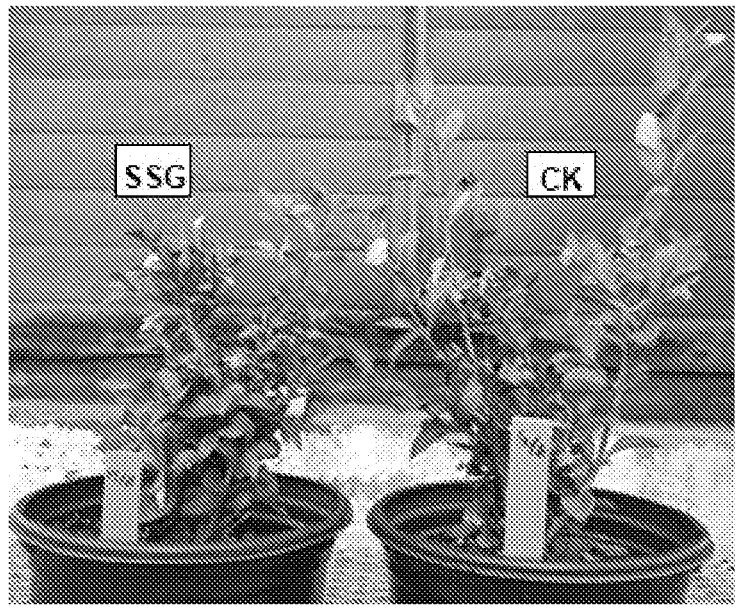
FIGS. 7A-7D show plant disease suppression with a SSG cell suspension applied on foliage one day before inoculation with a pathogen in comparison with the control (CK, nutrient broth).
Figure 7B:
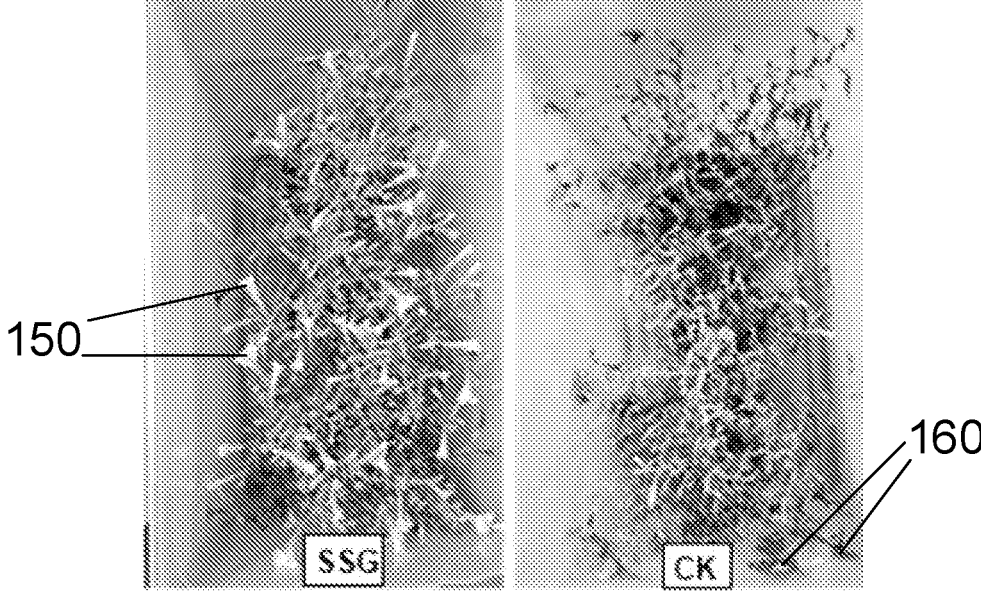

SSG may also use other mechanisms for plant protection in other phytopathosystems. In *petunia—Botrytis cinerea*, best efficacy did not occur in treatments at 1bdi but did in the treatment at 1wdi. Even treatments at 2 wbi and 4 wbi were more effective than that at 1dbi. This pattern is similar to that found with fungal biocontrol agent *Trichoderma koningiop- sis* for boxwood blight, which was more effective for treat- ments with great intervals, suggesting that disease suppres- sion may result from indirect antagonism of the biocontrol agent through competition and induction of host resistance or the Induced Systemic Resistance (ISR). In pansy—*C. fruticola*, SSG gave very similar protection for treatments at 1 dbi, 1 wbi and 2 wbi (Table 6) which may also be attributed to the same antagonism mechanism. In fact, SSG is a great producer of siderophores, indicating its ability of Fe defi- ciency response reduction and Fe acquisition improvement, which is an important feature of ISR eliciting microbes. With reference to FIG. 7B, SSG-treated *petunia* showed larger, healthier flowers 150 compared to nutrient broth- treated plants, which had numerous dead/browned parts 160.

Figure 7C:
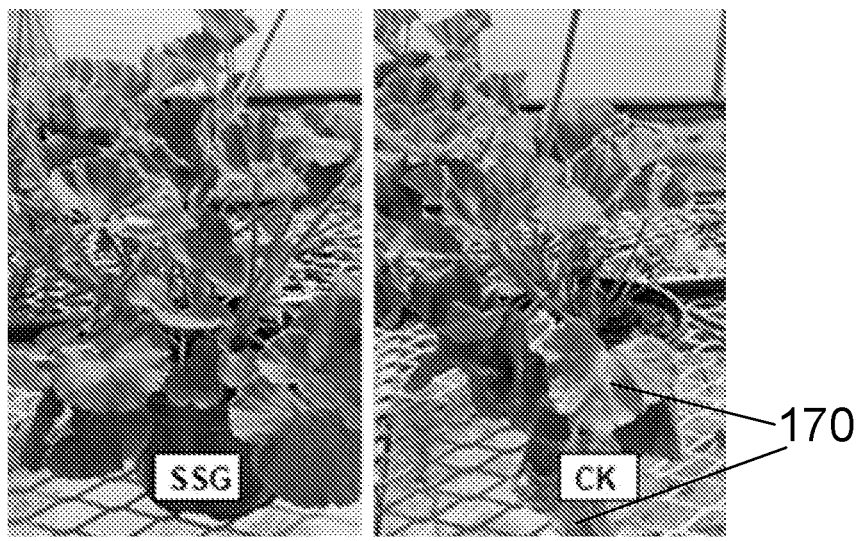

Post treatment with SSG was not as effective as pre- treatment in the phytopathosystems investigated. Among the evaluated six systems, the best result was found in gera- nium—*Xanthomonas campestris* (Table 6). With reference to FIG. 7C, the treatment at three days after plants inocu- lation with the pathogen (3 dai) resulted in 55% reduction of geranium blight 170, a rate similar to the pretreatment at 1 dbi and 1wdi. However, in other five systems, SSG was not effective or at a very low level. This difference in different phytopathosystems seems associated with pathogen type. SSG potently suppressed spore germination (FIG. 5) but was less effective on mycelia, particularly those fast-growing filamentous fungi and *Phytophthora* (Table 5). In contrast, SSG can directly suppress the bacterial pathogen given that it shares features of bacteria that do not differentiate in cell growth and enter plant tissue through natural openings or wounds. Therefore, SSG may be used as not only a protec- tive but also a curative biocontrol agent for diseases caused by bacterial pathogens it suppresses.

Figure 7D:
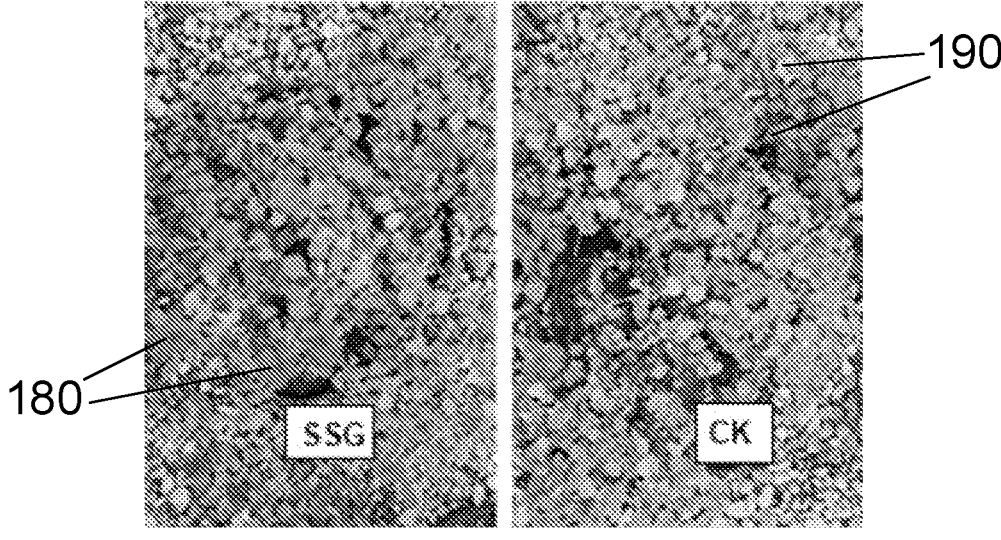

There was great variation in results for treatments in *impatiens*-TWSV and two root disease systems. In *impa- tiens*-TWSV, treatment at 2 wbi other than two other treat- ments at short lead times resulted in 53% control of TWSV (Table 6). Furthermore, treatment at 4 wbi brought a nega- tive result and significant variations among the replicates. With reference to FIG. 7D, SSG-treated plants displayed healthy flowers 180, while nutrient broth-treated plants displayed smaller, wilted flowers 190. In Fraser fir—*P. cinnamomi*, SSG treatment at 1 dbi resulted in a significant reduction of plants root rot by 46% compared to the control, although experimental differences of treatments were also significant. In addition, treatments at other lead times and 3 dai showed results that were either not significantly different from the control or presented significant differences among replicates. In *petunia—P. nicotianae*, there was as high as 75% reduction for treatment at 2 wbi but negative results for other treatments, although the results had no significant differences with the control because of experimental variations. The cause of these variations is not clear. However, many factors could involve. SSG as root inoculant may not be as efficient as it used as foliage inoculant since it is a foliage endophyte despite its survival in pine bark dominant potting mix. Moreover, our knowledge of SSG ecology and its interaction with plants is yet limited.

Factors such as overhead irrigation and rain full events after plant treatments that may affect minimal concentration for activities of SSG and methods used for pathogen inoculation, which may result in consistent plant infection are warranted to be further investigated.

In summary, SSG is a promising biocontrol agent for a variety of plant diseases. SSG was effective not only for fungal and *Phytophthora* diseases but also bacterial, and viral diseases although control efficacy for some of the diseases was low. This spectrum of antagonism, including viral disease, has not been reported for any biocontrol agents documented. The broad antagonism spectrum of SSG may be attributed to its ability to biosynthesize antibiotics, lytic enzymes and insecticidal products, physical and chemical interference and competition with pathogens or ISR induction. However, further studies on its ecology, interaction with plants and its risk to human health is warranted for the application of SSG in the field.

It should be emphasized that the above-described embodiments of the present disclosure are merely possible examples of implementations set forth for a clear understanding of the principles of the disclosure. Many variations and modifications may be made to the above-described embodiment(s) without departing substantially from the spirit and principles of the disclosure. All such modifications and variations are intended to be included herein within the scope of this disclosure and protected by the following claims.

REFERENCES

1. Anonymous. Chlorothalonil Fungicide Banned in European Union. 2019. Available online: <vegetablegrowers-news.com/news/chlorothalonil-fungicide-banned-in-european-union/> accessed Feb. 22, 2020).
2. Aziz, R. K., et al, (2008) The RAST Server: rapid annotations using subsystems technology. BMC Genomics 9, 75-75.
3. Baldwin, A. et al. (2005) Multilocus sequence typing scheme that provides both species and strain differentiation for the *Burkholderia cepacia* complex. J Clin Microbiol 43, 4665-4673.
4. Batdorf, L. R. Boxwood Handbook—A Practical Guide to Knowing and Growing Boxwood, 3rd ed.; The American Boxwood Society: Boyce, VA, USA, 2005; p. 123.
5 Batista, B. D., et al. (2018) Screening of tropically derived, multi-trait plant growth-promoting rhizobacteria and evaluation of corn and soybean colonization ability. Microbiol Res 206, 33-42.
6. Baudoin, A.; et al. Evaluation of fungicides for control of boxwood blight, 2014. Plant Dis. Manag. Rep. 2015, 9, OT006.
7. Benková, E., et al. (2003) Local, efflux-dependent auxin gradients as a common module for plant organ formation. Cell 115, 591-602.

8. Bevivino, A., et al, 1994. Phenotypic comparison between rhizosphere and clinical isolates of *Burkholderia cepacia*. Microbiology 140, 1069-1077.
9. Bevivino, A., et al. (1998) Characterization of a free-living maize-rhizosphere population of *Burkholderia cepacia*: effect of seed treatment on disease suppression and growth promotion of maize. FEMS Microbiol Ecol 27, 225-237.
10. Blin, K., et al, (2019) antiSMASH 5.0: updates to the secondary metabolite genome mining pipeline. Nucleic Acids Res. 47, W81-W87.
11. Bunt, C. R.; et al. Coated solid substrate microbe formulations: *Pseudomonas* spp. and zeolite. In Microbial-Based Biopesticides: Methods and Protocoles, Methods in Molecular Biology; Glare, T. R., et al, Eds.; Humana Press: New York, NY, USA, 2016; Volume 1477, pp. 49-57.
12. Calabro, J. M. (2018). Reclaiming boxwood from boxwood blight, Nursery Management, <www.nurserymag-.com/article/reclaiming-boxwood-from-blight-calabro/#>, accessed Feb. 8, 2021.
13. Campbell, E., et al, (1997) A polyketide-synthase-like gene is involved in the synthesis of heterocyst glycolipids in *Nostoc punctiforme* strain ATCC 29133. Arch. Microbiol. 167, 251-258.
14. Choi, J., et al, 2013. Fungal plant cell wall-degrading enzyme database: a platform for comparative and evolutionary genomics in fungi and Oomycetes. BMC Genomics 14 Suppl 5, S7-S7.
15. Choudhary, B., et al, 2014. Fungal cell-wall lytic enzymes, antifungal metabolite(s) production, and characterization from *Streptomyces exfoliatus* MT9 for controlling fruit-rotting fungi. Journal of Basic Microbiology 54, 1295-1309.
16. Cinquerrui, A.; et al. Integrated management for the reduction of *Calonectria* infections in ornamental nurseries. Plant Dis. 2017, 101, 165-169.
17. Coenye, T., et al, (2003) Diversity and significance of *Burkholderia* species occupying diverse ecological niches. 5, 719-729.
18. Compant, S., et al, (2008) Diversity and occurrence of *Burkholderia* spp. in the natural environment. FEMS Microbiol. Rev. 32, 607-626.
19. Compant, S., et al. (2005) Use of plant growth-promoting bacteria for biocontrol of plant diseases: Principles, mechanisms of action, and future prospects. Appl Environ Microbiol 71, 4951-4959.
20. Crennell, S. J., et al, (2000) The predicted structure of photopexin from *Photorhabdus* shows the first haemopexin-like motif in prokaryotes. FEMS Microbiol. Lett. 191, 139-144.
21. Crepel, C., et al. (2003) First report of blight on *Buxus* spp. caused by *Cylindrocladium buxicola* in Belgium. Plant Disease 87:1539.
22. Daughtrey, M. L. Boxwood blight: Threat to ornamentals. Annu. Rev. Phytopathol. 2019, 57, 189-209.
23. De Smet, B., et al, 2015. *Burkholderia stagnalis* sp. nov. and *Burkholderia territorii* sp. nov., two novel *Burkholderia cepacia* complex species from environmental and human sources. Journal of Systematic and Evolutionary Microbiology 65, 2265-2271.
24. Depoorter, E., et al. (2016) *Burkholderia*: an update on taxonomy and biotechnological potential as antibiotic producers. Applied Microbiology and Biotechnology 100: 5215-5229.
25. Diaz Herrera, S., et al. (2016) Wheat seeds harbour bacterial endophytes with potential as plant growth pro-

53 moters and biocontrol agents of Fusarium *graminearum*. Microbiological Research 186-187:37-43.

26. el-Banna, N., et al, 1998. Pyrrolnitrin from *Burkholderia cepacia*: antibiotic activity against fungi and novel activities against streptomycetes. Journal of Applied Microbiology 85, 69-78.

27. Eljounaidi, K.; et al. Bacterial endophytes as potential biocontrol agents of vascular wilt diseases—Review and future prospects. Biol. Control 2016, 103, 62-68.

28. Elmhirst, J. F., et al. (2013) First report of box blight caused by *Cylindrocladium pseudonaviculatum* (*C. buxicola*) in British Columbia, Canada. Plant Disease 97:559.

29 Estrada-De Los Santos, P., et al. (2001) *Burkholderia*, a genus rich in plant-associated nitrogen fixers with wide environmental and geographic distribution. Appl Environ Microbiol 67, 2790.

30. Fan, Q., et al, (2005) Clustered genes required for synthesis and deposition of envelope glycolipids in *Anabaena* sp. strain PCC 7120. Mol. Microbiol. 58, 227-243.

31. Ganci, M. L. et al. Susceptibility of commercial boxwood cultivars to *Cylindrocladium buxicola*, the causal agent of box blight (ABstr.). Phytopathology 2013, 103, 47.

32. Ganci, M. L. Investigation of Host Resistance in *Buxus* Species to the Fungal Plant Pathogen *Calonectria pseudonaviculata* (=*Cylindrocladium buxicola*), the Causal Agent of Boxwood Blight and Determination of Overwinter Pathogen Survival. Master's Thesis, North Carolina State University, Raleigh, NC, USA, 2014.

33. Gehesquière, B. *Cylindrocladium buxicola* (syn. *Calonectria pseudonaviculata*) on *Buxus*: Molecular Characterization, Epidemiology, Host Resistance and Fungicide Control. Ph.D. Thesis, Ghent University, Ghent, Belgium, 2014.

34. Germida, J. J. et al. (1996) Plant growth-promoting rhizobacteria alter rooting patterns and arbuscular mycorrhizal fungi colonization of field-grown spring wheat. Biol Fertility Soils 23, 113-120.

35 Ghosh, R., et al. (2016) Role of phosphate solubilizing *Burkholderia* spp. for successful colonization and growth promotion of *Lycopodium* cemuum L. (Lycopodiaceae) in lateritic belt of Birbhum district of West Bengal, India. Microbio/Res 183:80-91.

36. Gillis, M., et al. (1995) Polyphasic taxonomy in the genus *burkholderia* leading to an emended description of the genus and proposition of *Burkholderia Vietnamiensis* sp. Nov. for N2-fixing isolates from rice in Vietnam. Int J Syst Evol Microbiol 45, 274-289.

37. Gilson, D. et al, (2018) Boxwood blight found in Wisconsin for the first time. <datcp.wi.gov/Pages/News_Media/BoxwoodBlightFound.aspx> accessed Feb. 8, 2021.

38. Glick, B. R. (2012) Plant growth-promoting bacteria: Mechanisms and applications Scientifica 2012, 15.

39. Glick, B. R. (2014) Bacteria with ACC deaminase can promote plant growth and help to feed the world. Microbiological Research 169:30-39.

40. Gonzalez, C. F.; et al. Bacteriocin, plasmid and pectolytic diversity in Pseudommnas *cepacia* of clinical and plant origin. J. Gen. Microbiol. 1979, 110, 161-170.

41. Gonzalez, C. F.; et al. Mobilization, cloning, and sequence determination of a plasmid-encoded polygalacturonase from a phytopathogenic *Burkholderia* (*Pseudomonas*) *cepacia*. Mol. Plant-Microbe Interact. 1997, 10, 840-851.

42. Gorgiladze, Z., et al. (2011) First report of box blight caused by Cylindrocladiumbuxicola in Georgia. New Disease Reports 23:24.

43. Ha, J. K., et al, (2019) Application of the whole genome-based bacterial identification system, TrueBac ID, using clinical isolates that were not identified with three matrix-assisted laser desorption/ionization time-of-flight mass spectrometry (maldi-tof ms) systems. Annals of laboratory medicine 39, 530-536.

44. Hardoim, P. R., et al, (2008) Properties of bacterial endophytes and their proposed role in plant growth. Trends Microbiol. 16, 463-471.

45. Healy, S. E. Biology and Management of Box Blight Caused by *Cylindrocladium buxicola*. Master's Thesis, The University of Guelph, Toronto, ON, Canada, 2014.

46. Henricot, B. Box blight rampages onwards. Plantsman 2006, 5, 153-157.

47. Henricot, B. et al. Evaluation of foliar fungicide sprays for the control of boxwood blight, caused by the fungus *Cylindrocladium buxicola*. Plant Health Progr. 2013.

48. Henricot, B., et al, (2008) Studies on the control of *Cylindrocladium buxicola* using fungicides and host resistance. Plant Disease 92:1273-1279.

49. Henricot, B., et al. (2000) A new blight disease on *Buxus* in the UK caused by the fungus Cylindroladium. Plant Pathology 49:805.

50. Henricot, B.; et al. Studies on the control of *Cylindrocladium buxicola* using fungicides and host resistance. Plant Dis. 2008, 92, 1273-1279.

51. Henry, D. A.; et al. Identification of *Burkholderia cepacia* isolates from patients with cystic fibrosis and use of a simple new selective medium. J. Clin. Microbiol. 1997, 35, 614-619.

52. Hoffman, B. M., et al, (2014) Mechanism of nitrogen fixation by nitrogenase: the next stage. Chem. Rev. 114, 4041-4062.

53. Hong, C. X. Fighting plant pathogens together. Science 2019, 365, 229.

54. Hong, C. X. Saving American gardens from boxwood blight. Boxwood Bull. J. Am. Boxwood Soc. 2019, 58, 4-10.

55. Hwang, J., et al. (2002) Pyrrolnitrin production by *Burkholderia cepacia* and biocontrol of *Rhizoctonia* stem rot of poinsettia. Biological Control 25:56-63.

56. Ivors, K. L.; et al. Evaluation of fungicides for the prevention of boxwood blight, 2012. Plant Dis. Manag. Rep. 2013, 7, OT014.

57. Ivots, K. L., et al. (2012) First report of boxwood blight caused by *Cylindrocladium pseudonaviculatum* in the United States. Plant Disease 96:1070.

58. Jeng, W.-Y., etal, 2011. Structural and functional analysis of three B-glucosidases from bacterium *Clostridium cellulovorans*, fungus *Trichoderma reesei* and termite *Neotermes koshunensis*. Journal of Structural Biology 173, 46-56.

59. Joy, A. E. et al. (1994) Biocontrol of *Alternaria* leaf blight on American *ginseng* by *Burkholderia cepacia* AMMD. In The Challenge of the 21st Century Proc Inc *Ginseng* Conf eds. Bailey, W. G., et al. pp. 93-100. Vancouver, BC: Simon Fraser University.

60. Junaid, J. M., et al, 2013. Commercial biocontrol agents and their mechanism of action in the management of plant pathogens. International Journal of Modern Plant and Animal Sciences 1, 39-57.

61. Khan, M. S., et al. (2007) Role of phosphate-solubilizing microorganisms in sustainable agriculture—A review. Agronomy for Sustainable Development 27, 29-43.

62. Khatun, A., et al, 2018. *Pseudomonas* and *Burkholderia* inhibit growth and asexual development of *Phytophthora capsici*. Zeitschrift für Naturforschung 73 (3-4) c: 123-135.

63. Kong, P. et al. (2019) Utilization of plant endophytes for control of boxwood blight. Proc South Nurs Assoc Res Conf 63, 115-117.

64. Kong, P., 2019. Evaluation of a novel endophytic *Pseudomonas lactis* strain for control of boxwood blight. Journal of Environmental Horticulture 37, 39-43.

65. Kong, P., et al, (2017) Biocontrol of boxwood blight by *Trichoderma koningiopsis* Mb2. Crop Protect. 98, 124-127.

66. Kong, P., et al, (2020) A potent *Burkholderia* endophyte against boxwood blight caused by *Calonectria pseudonaviculata*. Microorganisms 8 (2), 310.

67. Kong, P., et al, 2010. Zoospore density dependent behaviors of *Phytophthora nicotianae* are autoregulated by extracellular products. Phytopathology 100, 632-637.

68. Kong, P., et al, 2010. Zoospore interspecific signaling promotes plant infection by *Phytophthora*. BMC Microbiology 10: e313. Published online.

69. Kong, P., et al, 2012. Effect of electrical conductivity on survival of *Phytophthora alni, P. kernoviae* and *P. ramorum* in a simulated aquatic environment Plant Pathology 61:1179-1186.

70. Kong, P., et al, 2020. Characterization of boxwood endophytic *Burkholderia cepacia* SSG as a plant growth promoter Letters in Applied Microbiology Under review.

71. Kong, P., et al, 2020. Complete genome sequence of a boxwood endophyte *Burkholderia* cepacian SSG with broad biotechnological application potential. Biotechnology Reports Under review.

72 Kong, P., et al. (2016) First report of blight of *Sarcococca hookeriana* var. *humilis* by *Calonectria pseudonaviculata* in Virginia. Plant Disease 100:247.

73. Kong, P., et al. (2017) First report of *Pachysandra terminalis* leaf spots by *Calonectria pseudonaviculata* in Virginia. Plant Disease 101:509.

74. Kong, P., et al. (2019) Variation in infection of boxwood, pachysandra and sweetbox by *Calonectria pseudonaviculata*. Planta, 249:831-838.

75. Kong, P.; et al. Host responses and impact on the boxwood blight pathogen, *Calonectria pseudonaviculata*. Planta 2019, 249, 831-838.

76. Koren, S., et al, (2017) Canu: scalable and accurate long-read assembly via adaptive k-mer weighting and repeat separation. 27, 722-736.

77. LaMondia, J. A. Management of *Calonectria pseudonaviculata* in boxwood with fungicides and less susceptible host species and varieties. Plant Dis. 2015, 99, 363-369.

78. LaMondia, J. A. *Pachysandra* species and cultivar susceptibility to the boxwood blight pathogen, *Calonectria pseudonaviculata*. Plant Health Progr. 2017, 18:41-43.

79. LaMondia, J. A.; et al Susceptibility of boxwood accessions from the National Boxwood Collection to boxwood blight and the potential for differences between *Calonectria pseudonaviculata* and *C. henricotiae*. HortScience 2017, 52, 873-879.

80. LaMondia, J. A.; et al. *Calonectria pseudonaviculata* can cause leaf spot and stem blight of *Pachysandra procumbens*. Plant Health Progr. 2013.

81. LaMondia, J. A.; et al. First report of *Cylindrocladium pseudonaviculatum* causing leaf spot of *Pachysandra terminalis*. Plant Dis. 2012, 96, 1069.

82. LeBlanc, N., et al, (2018) Boxwood blight: an ongoing threat to ornamental and native boxwood. Applied Microbiology and Biotechnology 102:4371-4380.

83. Liaqat, F. et al. (2016) Identification and characterization of endophytic bacteria isolated from in vitro cultures of peach and pear rootstocks. 3 Biotech 6, 120-120.

84. Likins, T. M., et al. (2019) Preventing soil inoculum of *Calonectria pseudonaviculata* from splashing onto healthy boxwood foliage by mulching. Plant Disease, 103:357-363.

85. Lu, S.-E., et al, 2009. Occidiofungin, a unique antifungal glycopeptide produced by a strain of *Burkholderia contaminans*. Biochemistry 48, 8312-8321.

86. Ludwig-Müller, J. (2011) Auxin conjugates: their role for plant development and in the evolution of land plants. J Exp Bot 62, 1757-1773.

87. Mahenthiralingam, E., et al, (2005) The multifarious, multireplicon *Burkholderia cepacia* complex. Nature Reviews Microbiology 3, 144-156.

88. Mahenthiralingam, E., et al, 1997. Identification and characterization of a novel DNA marker associated with epidemic *Burkholderia cepacia* strains recovered from patients with cystic fibrosis. Journal of Clinical Microbiology 35, 808-816.

89. Mahenthiralingam, E., et al, 2000. DNA-based diagnostic approaches for identification of *Burkholderia cepacia* complex, *Burkholderia vietnamiensis, Burkholderia multivorans, Burkholderia stabilis, Burkholderia cepacia* genomovars I and III. Journal of Clinical Microbiology 38, 3165-3173.

90. Malapi-Wight, M.; et al. *Sarcococca* blight: Use of whole-genome sequencing for fungal plant disease diagnosis. Plant Dis. 2016, 100, 1093-1100.

91. Mendes, R., et al. (2007) Diversity of cultivated endophytic bacteria from sugarcane: Genetic and biochemical characterization of *Burkholderia* cepacian complex isolates. Appl Environ Microbiol 73, 7259-7267.

92. Michiels, J., et al, (1998) The *Rhizobium etli* rpoN locus: DNA sequence analysis and phenotypical characterization of rpoN, ptsN, and ptsA mutants. J. Bacteriol. 180, 1729-1740.

93. Miethke, M., et al. (2007) Siderophore-Based Iron Acquisition and Pathogen Control. Microbiology and Molecular Biology Reviews: MMBR 71:413-451.

94. Nautiyal, C. S. (1999) An efficient microbiological growth medium for screening phosphate solubilizing microorganisms. FEMS Microbiol Lett 170, 265-270.

95. Nejad, P. et al. (2000) Endophytic bacteria induce growth promotion and wilt disease suppression in oilseed rape and tomato. Biol Control 18, 208-215.

96. Nübel, U.; et al. Sequence heterogeneties of genes encoding 16S rRNAs in *Paenibacillus polymyxa* detected by temperature gradient gel electrophoresis. J. Bacteriol. 1996, 178, 5636-5643.

97. Omomowo, O. I.; et al. Bacterial and fungal endophytes: Tiny giants with immense beneficial potential for plant growth and sustainable agricultural productivity. Microorganisms 2019, 7, 481.

98. Pal, K. K. et al, 2006. Biological control of plant pathogens. The Plant Health Instructor. Am. Phytopath. Soc., 10.1094/PHI-A-2006-1117-02.

99. Parke, J L., et al. (2001) Diversity of the *Burkholderia cepacia* complex and implications for risk assessment of biological control strains. Annual Review of Phytopathology 39:225 258.

100. Pradhan, S. et al. (2013) Spectrophotometric Determination of Phosphate in Sugarcane Juice, Fertilizer, Detergent and Water Samples by Molybdenum Blue Method. Scientific World, 11:58-62.

101. Qureshi, M. A., et al. (2012) Role of phosphate solubilizing bacteria (PSB) in enhancing p availability and promoting cotton growth. Journal of Animal and Plant Sciences 22, 204-210.

102. Reijnders, L. (2014) Phosphorus resources, their depletion and conservation, a review. Resources, Conservation and Recycling 93, 32-49.

103. Reinhold-Hurek, B., et al, 2011. Living inside plants: bacterial endophytes. Current Opinion in Plant Biology 14, 435-443.

104. Rekanovic, E., et al, 2008. Efficacy of antibiotics and copper compounds in *Erwinia amylovora* control in Serbia. International Society for Horticultural Science (ISHS), Leuven, Belgium, pp. 875-878.

105. Richardson, P. A.; et al. Indications of susceptibility to *Calonectria pseudonaviculata* in som common groundcovers and boxwood companion plants. Plant Dis. 2019.

106. Ridley, G. New plant fungus found in Auckland box hedges (*Buxus*). For. Health News 1998, 77, 1-2.

107. Rodriguez, H., et al, (1999) Phosphate solubilizing bacteria and their role in plant growth promotion. Biotechnol. Adv. 17, 319-339.

108. Romera, F. J., et al, 2019. Induced Systemic Resistance (ISR) and Fe Deficiency Responses in Dicot Plants. Frontiers in Plant Science 10, 287.

109. Rosenblueth, M., et al (2006) Bacterial endophytes and their interactions with hosts. Molecular Plant-Microbe Interactions 19:827-837.

110. Ryan, C.; et al. Susceptibility of *Sarcococca* taxa to boxwood blight by *Calonectria pseudonaviculata*. Proc. South. Nurs. Assoc. Res. Conf. 2018, 62, 64-67.

111. Sajjan, U.S., et al, 1995. Cable (cbl) type II pili of cystic fibrosis-associated *Burkholderia* (*Pseudomonas*) *cepacia*: nucleotide sequence of the cblA major subunit pilin gene and novel morphology of the assembled appendage fibers. Journal of Bacteriology 177, 1030.

112. Santoyo, G., et al, 2016. Plant growth-promoting bacterial endophytes. Microbiological Research 183, 92-99.

113. Santoyo, G., et al. (2012) Mechanisms of biocontrol and plant growth-promoting activity in soil bacterial species of *Bacillus* and *Pseudomonas*: a review. Biocontrol Sci Technol 22, 855-872.

114. Saracchi, M., et al. (2008) Box blight, a new disease of *Buxus* in Italy caused by *Cylindrocladium buxicola*. Journal of Plant Pathology 90:581-584.

115. Saunders, P. Boxwood Guide, 5th ed.; The Saunders Brothers Family: Piney River, VA, USA, 2017; p. 95.

116. Savary, S., et al, 2012. Crop losses due to diseases and their implications for global food production losses and food security. Food Security 4, 519-537.

117. Schikora, A, et al. (2016) Beneficial effects of bacteria-plant communication based on quorum sensing molecules of the N-acyl homoserine lactone group. Plant Mol Biol 90:605-612.

118. Schluenzen, F., et al, 2006. The antibiotic kasugamycin mimics mRNA nucleotides to destabilize tRNA binding and inhibit canonical translation initiation. Nature Structural & Molecular Biology 13, 871-878.

119. Schulz, B., et al, 1999. The endophyte-host interaction: a balanced antagonism? Mycological Research 103, 1275-1283.

120. Schwyn, B. et al. (1987) Universal chemical assay for the detection and determination of siderophores. Anal Biochem 160, 47-56.

121. Seemann, T., (2014) Prokka: rapid prokaryotic genome annotation. Bioinformatics 30, 2068-2069.

122. Shishkoff, N.; etal. Evaluating boxwood susceptibility to *Calonectria pseudonaviculata* using cuttings from the national boxwood collection. Plant Health Progr. 2015, 16, 11-15.

123. Sopheareth, M., et al. (2013) Biocontrol of late blight (*Phytophthora capsici*) disease and growth promotion of pepper by *Burkholderia cepacia* MPC-7. The Plant Pathology Journal 29, 67-76.

124. Suárez-moreno, Z. R., et al, (2012) Common Features of Environmental and Potentially Beneficial Plant-Associated *Burkholderia*. Microb. Ecol. 63, 249-266.

125. Suleman, M., et al, (2018) Phosphate solubilizing bacteria with glucose dehydrogenase gene for phosphorus uptake and beneficial effects on wheat. PLOS ONE 13, e0204408.

126. Tawfik, K. A., et al, Burkholdines 1097 and 1229, potent antifungal peptides from *Burkholderia ambifaria* 2.2n. Organic Letters 12, 664-666.

127. Trân Van, V., et al. (2000) Repeated beneficial effects of rice inoculation with a strain of *Burkholderia vietnamiensis* on early and late yield components in low fertility sulphate acid soils of Vietnam. Plant Soil 218, 273-284.

128. Vandamme, P., et al. (1997) Occurrence of multiple genomovars of *Burkholderia cepacia* in cystic fibrosis patients and proposal of *Burkholderia multivorans* sp. nov. Int J Syst Evol Microbiol 47, 1188-1200.

129. Varela, C. P., Penalta, B. G., Vazquez, J. P. M., and Casal, O. A. (2009) First report of *Cylindrocladium buxicola* on 130. Vitale, A.; et al. *Calonectria* diseases on ornamental plants in Europe and the Mediterranean basin: An overview. J. Plant Pathol. 2013, 95, 463-476.

131. Walker, R., et al (2015, Symbiotic nitrogen fixation in legumes: Perspectives on the diversity and evolution of nodulation by *Rhizobium* and *Burkholderia* species. In Biological Nitrogen Fixation.

132. Weilharter, A., et al. (2011) Complete genome sequence of the plant growth-promoting endophyte *Burkholderia phytofirmans* strain PsJN. J Bacteriol 193, 3383.

133. Yabuuchi, E., et al, (1992) Proposal of *Burkholderia* gen. nov. and transfer of seven species of the genus *Pseudomonas* homology group II to the new genus, with the type species *Burkholderia cepacia* (Palleroni and Holmes 1981) comb. nov. Microbiol. Immunol. 36, 1251-1275.

134. Yang, T., et al, (2014) Chrysanthemyl diphosphate synthase operates in planta as a bifunctional enzyme with chrysanthemol synthase activity. The Journal of biological chemistry 289, 36325-36335.

135. Yang, X. et al. (2018) Biological control of boxwood blight by *Pseudomonas protegens* recovered from recycling irrigation systems. Biol Control 124, 68-73.

136. Yang, X.; et al. Evaluation of biofungicides for control of boxwood blight on boxwood, 2017. Plant Dis. Manag. Rep. 2017, 11, OT023.

137. Yoon, S.-H.; et al. Introducing EzBioCloud: A taxonomically united database of 16S rRNA gene sequences and whole-genome assemblies. Int. J. Syst. Evol. Microbiol. 2017, 67, 1613-1617.

138. Yoshihisa, H., et al (1989) Production of antibiotics by *Pseudomonas cepacia* as an agent for biological control of soilborne plant pathogens. Soi/Biology and Biochemistry 21:723-728.

139. Zhao, Y. (2010) Auxin biosynthesis and its role in plant development. Annu Rev Plant Biol 61, 49-64.

140. Zhao, Y. (2012) Auxin biosynthesis: a simple two-step pathway converts tryptophan to indole-3-acetic acid in plants. Molecular plant 5, 334-338.

SEQUENCE LISTING (6 sequences)

SEQ ID NO: 1 - DNA, 5470797 bp, Burkholderia cepacia strain SSG (residues 1-1,823,599 of 5,470,797)
agaacggcaacgtgcgggcgcgggtggcgccgcggttttgccgctggcggggatgaggccgagtagcgcgtcgaagctcgcggtgagggagcaaacccggcgttatcgtgagggcattctggatagagccaaagttggtaccgaacaaggtgcggtgaaatctcgatcgaatcaggagcggacatgtcccacaccattctggccagcgtgacggcgagcgtttcgagctgaagcggagcccgacgggaaccgtggcggtgggcgagggcttcccggtcgcgatcctgaaccacaacgaaccggcgttctactgcatcccggcgaagacatgggaggcgatggtcgaacgtctcgaggatatcgaagacaacgcgctcgtcgattcgcgcgccaacggaaagtcgtcaaggtcaaactggttgacctttgagttcgccttgctcgaacctgcgttgaaggcgtggaagaagctcgatcgaaccgttcgcgatcggttcgaggcgagacttgccgaacggctcgaaaatcctcgcattccttcggccaggccgtgcgacacgcgctgtggcttcggcgtttcgcggcttgtctcgtcgaaccggccggtgccgcccgtcaggccgtctcttccggcgcatccggcatcttcccgtcgccgacgcggttgatcgtgccttgcgcgatcgcgacgagccgttcgtgatcgccgtcgatgacgaacacgtgacactggcaggtcgcctgatgccggcccgcgtacacgagcttcgcgcgcgcgacgagcgtgccgttcacggccggccgcaggtagttgatcttgtattcggccgtaatcacgcgcgggcccagcacgagcgcgccggcgaacgtcagcgcgttgtccgccaggtagctgatgacgccgccgtgcacgaacccgtgttgctgccggttcctcgcgcacgggcaggcacagcgacacttcgttgtcgccgatatgcatcagctccgtgcccagcagcatgctgaacggttgcgcgcgcaatgcgccgcgcgcgtgatccgtgatgtcggtcatcgaacttccttcgaaatgagcgcccgcttgcgctgaactctaggaagggggctgcggataagcaaggaaattcgtccgcatttcgtgcaaattccggcgcgatgcgacgcgattattgcgtcgaataccgaagatccccggtttgccggcgattccgcgggaatgcaggagcaacgtgaactttgccgtctcccggtcctaaagtccgacgaagaaatgccgctaatgccggggcattgcctcatcgtccgctttccaggaatctccccatgttcggaaaaatcaagctcgcgtcgggtctgctcggcgtgttgaccgtgttctgccttttcctgttcgcgatcgaggcgctcggcttctgggcgctcacgtcgacgcgcagcggcgtcgacgacctgtcgaacgtcgcgatcacgcaggtcggcgcggcgagccaggccacccagcaactgctcgacgcgcgcatcaacctgtcgcgcgccggcacgcggatggtgcgcggcggcccgaagccggacgacatcatccgccatgccggcgcgtcgctcgcggaagccgacaaggcgttcgccgcgctgacggccgtgcagccggtcgacgagatcaaccgcgcgcgcgtcgcggcgctcaccgagcgctatcgcgctgcgcggcgcgctgggcgaactcgtgcagttcctcgacgccggcaacatccaggcattcctcgaccagccgacgcagggcatccaggacgcctatatcgccgagctgcgccgcttcaccgactacggcggcacatcgagccgctcggcgctcgatacgatcgacggcggcatgctgtggttcaagtcggtcggcatcgtgctgctggtagcgatgctcgtggcgagcgcggcgatctacgcggccgcgcggcgcgcggtcgtcgcgccgctggaagaagccggccgccatttcgagcggatcgcgcagggccggctcgatgaagtcgtgcgggcaggcggcgtgttcgagatcgaccggatgctgcgcggcctcgcgacgatgcagacgagcatcgcgggcaccgtgcgcacggtgcgccaggcgtccgatgcgatccacctcggcgcgggcgagatcgcgggcggcaacgccgacctgtcggcgcgcacgggcacccaggccgcatcgctcgaggaaacggccgcgagcatggaggagctgacggcaaccgtccgtcagaacaccgacagcgcccgcgcggcgagcgcgctggccgacgcggcgctcgaggcgacgagccacggcggcggcgtggtcgacagcgtgatcgaccggatgcgcggcatcgcgcagagctcggggcggatcgcggagatcatctcggtgatcgacggcatcgcgttccagaccaacatcctggcgctgaacgcggccgtcgaggccgcgcgggccggcgaacagggccgcggctttgcggtcgtcgcgggcgaagtgcgctcgctcgcgcagcgcagcgcgcaatcggcgaaggagatcaaggcgctgatcgaggattcggtcgcgcagatcaacggcggcgcggaactcgtcgagcgcgccggcgaagcgatgcggacggtgtcgacgtcgatcacgcgcgtcgtgcagacgatgtccgagatcacctcggcgtcggtcgagcagagcgtcgggatcgagcaggtgaaccaggccgtcacgcagatggatcagctcacgcagcagaacgcggcgctggtcgaggaagtcgcggcggcggccgcgtcgctgaacgaccagacctcgcacctgatgcaggccgtgtcggtattcgaactgggcgacggccgtgccgcacgcgacgaacgcgcggcgccgtcgttcgccgggacgggttacgaaccggctggcagcgccgcgtaggcggtcgcgaggtggtagggcgtcgtcgacggcatgtcggcgcgcgacacctgcccgtcagccgtcttgcactcgaaccagccgcgcggatgcaggaagcgcgcggcgaagcgctcgatctgccgcgcgagcggcgcggaggccggcgtgccgccgtgcgtcgcgagcgcacgcaggtactccgtctgcgcccagatccgctgcgtgccgtcgacgcacgcgccttgcgcatcgagcgccgcgcagacgccgcccgtctgcggatcgacaccgtattgctccgcaaagccgaacgcgcgcgacagtgcagcgggagcccgtttgcgcgagccgcgcgccggccgcatcgaccaggtagaaccactcgaactgatgaccgggctcgaaacggttgtctgccgcgccgagcggcagctcggccacgcagccggtcgccgcgtcgacgaacgtgcgctcgacggcctgcgcggtgtgcgcgagcgcgtcgtcgaacgccgcgtcgccgaatgcatcggcagccgcgagccacgcttcggtcaggtgcatcagcggattctgcagcgccccgctgccggatgacgagaaatcggcgtggcgcgccgcatcgagcagcgcgtcgccgggatgcggcgcgaaacggtcgcggatcagcgcggcggtctcctcggccgtcgtgcgcgcggcggcgtcgcccgacgccgcataccaggcggcacacgcgaacacgatgaatgcgtgcgtatagagatccttggtcgtgtcgagcggcgcgccctgcgcgtcgacgctgtagatccagccgccgtggcgcgtgtcgcgaaagcgccggcccagcgcgtcgaacagcgtggctgcgtgcgcggtgtcgccggcctgcgcgaacacgaacagttgccgtgcgcacgccattgcgcgataacgggtcacgggcagcggcgcgtgggtggccggatcgacggcttcgaacggcagctgcaatgtctggtcgaaccctgaaccccgccagatcggcaagacgacgtgcgcgaaatggtggcgcagctgggcggcctgggcggaagcggagtcggaaacggacatgacggggttgagcgctgggttcgaaacgtgtcggcgcggcccggaggatcggcgcggccggggccaaggataaaacattccgcgcggccggcaccaaaaaggagataaatcgcatgctgagcaacctggaactcgtgatgcggctcgttctcgcggcggcgctcggcagcgtcatcggcttcgagcgcgagcgcctgtcgtgggccgccggcctgcgcacgcacatgctcgtctgtgtcggttcgacgctgatcatgatcgtgtcggcgttcggtttcgccgacgtgctcggcagcagcgaccacatcatgctcgatccgtcgcggatcgccgcgcaggtcgtgtcgggcatcggcttcctcggcgcgggttcgatcctgctgcgcggcgagatcgtgcgcgggctgacgaccgccgcgagcctgtggtcggtcgccgcgatcggccttgcggtgggcggcgggctgtacgtcgcgtcgatttcggcgacgatcatcatcctgatcatcctggccggcatcaagccgctgggcgctacttcacggtgcggcagcgccgtcaggtcgcgctgacggtcgtgagcggcacgctgaacttcgattcgctgcatgcggcgctcggcccggacagtgcgcgcgtgaagcagttcatcgtgcagcgtgccgacgacacgggcgagcacgacgaggtgcgcatcgcgctcgcgcgggtgtcggcgctcgaataccaggcgatctgcgacaagctgcgcgcgctgaagggcgtgacgcgttttgaagagggcaacgggctgtcgggcgacgaataggctgaatcggcaacggggcatgcgacaatggccgaccaccgattccgttcgacatccggttccgtgttcgcgggccccgctatccgatttccatgaccgaatccgtttcctcgcctcgctcccgttcccgttccaatcgttcgtcggcccgttcccgccagcgctcggctgctgccgcggggagtacgtccgcgagggcgacggcgcggtccggcagtgcgccggccgccgacgcgtcgcgggacgagcgaacgctcgacctgttcggcgatccggtgttcgagccgggcgagcgcgcgccggttgcggttcgcgacgaagcgggggcgcaggccgatgcagcggtcgatatcgcggacgatgtggcctccgggcggcagcccgcgctggacgggttcggtgcgcgggaaggggcgggcgcggcggcacatgcggaagcggcagagggcgcggtgatgccggaagtcgcgacggtggcccatggcgtttcggtgccgcaaggtgaggaggttgcagatgccgacatcgtgccggcctccggggctgttgcgatgaaggcggtcgatattcccgtggcgggtggcgttgcaacgaaatccgccgatgtgcccgcggccgacgccgtcacgatggcagcgaccaggctgcaggcggccgatgatacggcgccgaaggtggccgaagcgcaagcagctggcggcgaagttgagcaggctgttgtcgccgctgccgccgccgtcaaatcccgcgaagggcgatcttccggcgacgccgtgaaggagcgtcgtgcgtcgtcgggcggcaaacgtcgggcggctgccggtgcaagcgacgcgacagcagagcaatctgcgccagtcgtgacgagcgtcgacacggcgcgagcggcggccggggcgagtcctgcaccggacgcggtgtcgatcgtcgagccgcaggcgtcggcggagccgaccaagccggcagtcgccgcgaacccggtgaacacggcgaacacggcgaacacggcgaacacggcgaacacggcgaacacggcgaacacggcgaacacggcgaacacggcgaacacggcgaacacggcgaatattgcgaaggccgtggacgccgcgccgcaccccgacaccaccgtatccctgccacccagccgatggcttccgctgcgtcctttgtcacgaagccgtcggtggagcgcgcgcaaccggccgcgccggtcttcgatccggatacgcacctgcgtccgctgaccgaccgcctcgccgcgctgcaggccgacgtcgacggtttgacgcgcaccgccgatcgcgagatgcgccgcgtcaaccgcctgctgctggccttggccgtcgtcgtgctggccgggctcgttgcgctggtgcttcagacgcggcagatcgcgcacctgaagcaggacgtcgccacgaagcagcagcggatcgatcgcctcgcggccgatctgtcgacgcagcaggcaacgctgatgacgctcgaggagcatcacgaggcgcttctgtcgcaagtcgaccggctccagcgcaacgcgaatcgcgaggcggccgtcgcgaaacgtgcgcaccgcacgcgctaatcgtttcgaccctatcctgggagcccgacggagcaaggatcgcggttccgcgtcggcgatcaggcgctgcgggcatgcggcaaactgatgcggtgcgctggcagagttcaggaaaacccttagaatagcgtccatctaagggaaaaccctagtcacatctgtcaggagtctcacatgagcttcatcctcgccctgctgcaaaagatcgacgacctcttcgtgtcgccccacctgccgctcgacgccgaatactcgtacgctgcgcgtcgtgccgaagccgagcgcgtgcgccgtgcgcacctcgtgccgatcgtcctgtatcgtcgctgattcgctgattcgctgattcgctgattcgctgattcgctgattcgctgattcgctgattcgcggccagcgcggccccgccgcacctgcctgcccgctttccgccgccgcatcgcgccggcgcgaccgtcccgctacactggaagtccgaatccgttcacggtgaccgggccatgctgcagatgcggccgatgacggccagagaattccacgcgtaccgtacgcgagccatcgacggctacgcgcgcgatctcgtttcatccggacaaaatgctgtcgaagacgcgaccagccgggcgcgcgcctgtttcgacacgctgctgccggatggcttgcggacctccggccagaccctcgtcgtgctcgtcgacaccgccagcggcgacgcggtgggcgacctctggtacgcgatcgtgcccgaagggccgaaccgcacgctgttcatctacgacctcgacatcgtcccgtcccggcgtcgccagggctgggccacacgcacgctcgatgcgctcgacgtcgaggcgcgccgctacggcatcaccgagatcgggctgtcggtgttcaatcacaacacggcggcccgcgcgctgtatcgtgcgtgcggcttcgcgccgatcacgacgacgttgatcaagccggtcattccgggctgaatcggctggcaggcgctcagctgggacttgtggccaaccgggtacgtcgcgggcggcctgcaccgtccacactcccgatccttcctgctcgccgagcgccgagcgccgagccccgagccccgagcgccgagcgccgagcgccgagcgccgacccgagcccgagccccgagccccgagcccgagccccgagccccgagcgccgagcgccgagcgccgagccccgagccccgagccccgagcgccgagcgccgagccccgagcgccgagccccgagcccgagccccgagccccgagccccgagccccgagccccgagccccgagccccaagccccaagcaaccgaccccgaccatcaaacaccgacagccgaacggcccttcgaccattcgaccgtcctgcacgcgccgcccacccgctcagtgcgcgcgcctttccatctccgcagcagcagcgcattggtcacgacgctgacgctggaaaacgccatcgccgcgcccgcgatcaccgggttcagccagccgagcgccgcgagcggcacgccgaccaggttgtagacgaacgcccagaacaggttctgctggatcttccggtacgtgcgtctggagatgtcgatcgcatcggcgacgagcgccgggtcgccgcgcatcagcgtgatgccggccgtatgcatcgcgacgtcggtgccggtggccatcgcgatgccgacgtcggccgcggcaagcgcgggcgcatcgttgatcccgtcgccgaccatcgcgacgattccgccgtgcgtgcgcttcagctcggcgacgacgcgcgccttgtcgtcgggcagcacctgcgcatgcacctcgccgatgccgagcgacgccgcgacggctgccgcgctgccacggttgtcgcccgtcacgagcacgctcgcgacgccgcgcgccgacagtgccgcgatcgcgtcgcgggcgcccggcttcacggtgtcgccgaaagcgatcagcgcgagcaacgcgcgcggtgcatcggcgcgcatcagccacgagatcgtgttgcccgcgcgttcgagctccgccgcgcgcgcgtcgagcgcgggcggcacggcgatgccgagctcgtcgcgccagcgtgtgctgcccagcgcgagcaactgcccgccgacgcgggcttccacgccgcgtcccgccaccgcgcgcgcatcggccgcgcttgccggcggcaccgcactgccgcgcgcggcaacgtcagcgtcgtgcgcggcgaccacggcgcgcgcgagcggatggtcgctctgacgctgcaccgccgccgcgagtgcgagcgcttcgtcatgcggcacgccgacggcttcgaacgccgtcacggacggcttgccttcggtcagcgtgccggtcttgtcgaacgcgatcacggtggtgcgctgcgcgagttcgagcgcctgcgcatccttgatcagcacgccgcgccgcgccgcgacgcctgtgccggccatgatcgcggcgggcgtcgcgaggccgagcgcacacgggcacgcgatgacgagcaccgcgaccgcgttgaggatcgcggtttcggtgccggcgccggcgatcagccagccggccagcgtcagcacggcgatgccgaggatggcgggcacgaacacctcgctcacgcgatcgacgagccgctggatcggcgccttctcggcctgcgcggattcgacgaggcggatgatgcgcgcgagcgtcgtctccgcgccgatcgcggtggtttcgacgacgagcgcgccttcgccattgatcgagccggccgtgacggggtcgccgtcgtccttcggcaccggcaggctcgccggtgatcagcgattcgtcgatgtgcgagcgacccgacacgatccggccgtcgacgggcacgcgctcgccgggccggatgctgacgcgggtgccgacacgcacctgcgccagcggcacgtcgcgttcgacaccgtgctcgacgacgcgggcccggtcgggacgcaacgcgttcagcgcgcggatcgcgtcggtggtctggcgcttcgcgcgcgattcgagccatttgccgaagcgcaccagcgtgacgatgacggccgacgcttcgaaatacaggtggccgggatgggcggtgccgcgcagcagcatccacaggctcagcccgtatgcggccgacgtgccgagcgcgacgagcaggtccatgttgccggtgcgcgccttcaccgcgtgccaggccgcgcgatagaagcgcgcgccgaagccgaactggacgatcgaggcgagcacgagctggacccagccgttcggcatcaggtggatgccgaacggcgcgacgagcatcggcgcgatcagggcgcgctcagcaccgcagaccagatcacgagatcgcgttcgcggattgcttcgaggcgcttgcgtgtttcggggtcctgcgcggcgccggacggctgcgcgtcggcgccggccgtggcgccggctgacgacgcgtcggcgagcgacgcgcgatagccggcggtggtgacggccgcgatcagcgtggcggcgtcgagggcgccggcgccgtgcaccgacgcgcgctcggtcgcgaggttgaccgcaacgcgggcgacgcccggcacggcggccagcgcttttcgacgcggccgacgcaggacgcgcaggtcatgccgtcgatgtcgagttcgaggtcggcgggggcggtggaagcagccggcgggatggccgcgccggcaaccggcgtcgcgccgtatccggcttgtttgacggcttcagcgagccgggcggcggtaacgtcgggcgcggcgttcacggtcgcccgttcggtcgcgaggttgaccgacgcccgcgtgacgcccggcaccttcgccagtgctttctcgacgcgcgacacgcacgacgcgcaggtcatcccgtcgatgtcgagttcgatgctggcgggcgcggcaggcgaggagggggcgagcgcggcgaagcctgcatccgttacggtcggtgtcgcgccgtagccggcctgtttcacggtttccaccagttgtgcggcggaaacgtcggccgtgacatcgacggtcgcccgttcggtcgcgaggttgaccgacgcgcgcgtgacgcccggcaccttcgccagcgccttctcgacgcgcgacacgcaggacgcgcaggtcatcccgtcgatatcgagttcgacggtgctggtggccgggagcgggcggccggcagtcgaagcggctgcggccatcggcgtgggcgatgcttcgacaggatgcgcctgcgtggcggcggcgacttcgagcactggtgcgcgtacggaggcgccgtagccggctgcgccgatcgcctcgatcagtcgcgcggcgtcgatggtttcctgcgcagtcaccgtcgccgcgtgcgcgtcgaggtcgaccgccgcctcgacgacgcccggcaccgcggccagcgcccgttgcacgcggcccgtgcagccgccgcaatgcatgccgtcgacgctcagctcgatcgtgtgcagctgtggaggcaagtgattctgtcatgtcggattccctgaatgcacggctcgtgccgcgaatggaaccagtatcaacattcccatgatggtaaggtcaagcggtggcagcgcatgccgatgcacacagggtgtcacaacgcggaaagcaatctcccggattcctgaccgacatccgggaggggcgggcctttgcgctcgactgcgcgatcaggcgcagagcttggcgctcgcgagacgattcaggctgacgccctgctcggcggcctggatcaccagcgcgcggtgtgcctgcggcgggatgcgaaccttgaattcaccgctgtaggtgcggtcggcgatcggctcgggcaccttttctccgtttgcggtcatgtcgcgaatgacatcggcgacgagccggcgaataccggccagcgcaccttccggcgttgcgtcgagccacgaaagagacgggaattccgcgcacaggccaacgtgctccccgtcctccggggaccacgttacgcggtacgtaaagtggtcttgagtcatgatttctgttccttcagtcgatcgatcgcgtcgagaacctgtcgcacctgatcgtcgaatcgcacgttcgcaggctcgcgcctcatgagttcgaggatcttccatacgctagccgcatcgaatggtgtcattagtgacaccattcgtcaatcgaccagccggcccccgcactcgagattgtttcgccttgagcgtgtgtcgctccgatatcccctgttttgttgcaaatcgccagaactatttcgcatctgtcgacaatacggctagcgttcggccagctattcggcatattaggggatgcccgtaggcgctatgataccggcctgacatcagcgcccaccgttacgcaacgtcacgaaacggttatccgggcacgctggggtgccttgctttcgccattcgcgcgtcgcacaaggcgttgactgaaaagaacgatattcggccagtactcgatgattgaaaaccagcaggaatcagtttctctgcggcgcgtgtgcgcgtcgctggccatggcggcgttgcttgcggggtgcgcgtcgcaaccggatgccattcagcggaaaaccggctggatgcgcgcggaagtcgccgactcctatgtgaggcgtatccgctcgtgctgatggacgtcgcgaaggaagcggcgaccggcggcgacggcgcgcagccggggcaggcgccgctcaacacgctgcgccacgcgcaggcgctgccgcccgtcggcgcggtcaatccgccgctgccgggcgtcgacacgctcgactcgaccggctggctcgacgtcgccgccgaacccgtgatcgtcacgttgcccgacacgcgcggccgttactgggacgcgcgtgcgctcgacatgtggacgaacgtgctgtggtcgtcgtcgagcgtggctgcacgcggcacacgcggcggtgtgcgatcgcaaacgattgccttcgccgcgaaggattggcagggcacgctgccgaagggcggtccggatcgacgtcccgtcggccaacgcgtggctcgaagtccgcagacgagcggcgggcgcgacctgacgaacgtgaagaaattgcagcgcgcgatccgcgtggtgccgctgtccgtctacacggcggcgcgcggcgcgtcggtggcggtccatgcgggcagcgcgccgtccgaggcggtgggcggcggcacgccggccgagcaggtggccgcgctcgacccgaaggcgttcttcgcgcgcttcgcgcaggcgctgcaggacaacccggcgccggccgacgacgcacacgcgcaggcgttgctcggcgacatcggcgtgtcggccggctacccggtgctgtggacgggcgaccgcctcgcggccgcgacggccggcgtcgccgaggcgcgcgcgcggctcgcgaccccgccgtcgaacctgctgaacgcgaacggctggagctggatcggcgatacggccggcaagtacggccaggactacacgctgcgcgcgtacgcggcctacacgcagttcggcaccgcgacgcgcgacgacgaaacgctcgcggtcgtgcgtgtcgacagcgacggccatcagttgaacggagcgaaccgctacgtgctgcatttcgcgccgggcgcgctgccgccggttcgcgcgttctggacgctcacgccgtatgcgacgaacggcgcgctgcccgacgtcgggtcggcgcgccgctcgctcggcgatcgcgaccgcctgcgccgcaaccacgacgggtcgatcgacatcgtcgtgtcggcgtcgccaggcggcacgcatgcgggcaactggttgccggcgccgcgcgccgatttcgcactcgcgttgcgcctgtacgcaccgaagccgcaggcgagcgacgggtcgtggatgccgcccgtcgtcgtccggaaatgaacggatgaccggcggcgttgtccgaccggcgggcgcgacggcgcccgaaccccgtaccgtcacctcctgagcctatactttcgggatagcgtgcgcggccgaccggtgctccggtacggccggcatcccatcccgaggcattcaagcatggcaagcgcagacaaagaaaccgtatcctcgaccctccatgccctcggtggcgttgcacgctcgcgccgcacccggcgcatcggcctcggcctgctgatcttcctcgttttattcggactgctcgggttcttcgcggcgccgccgctgatccgccatatcgccgaacagcaactgagccagcaactcgaccgccccgccacgatccgacgcatcgcgctgaacccgtacacgctgaacctcgaagccgacggcatccatctcggcgacaagggcgggcagggcgacttcatcgacatcgcgaagctcgtcgtgcggccgtcgtggtcgtcgctgttccgcggtgcgccgatcgtcaatgaaatccgcctcgactcgccgcgcttccatatcgtccgctacgatgcgcagcgcttcaatttcaccgacctgatcgagaaattctcgacgccgtcgcccaaaccggaaagcaagccgacgcagttctcggtgtcgaacatccaggtcaacaacggccggatcgatttcgacgaccgcctgctgaacgaaaagcacgtcgtcgacaactggacgctcggcattccgtatatcgcgacgctggcgtcgaagaccgacatcttcgtcgagccgaagctgcgcgcgcgcttcgacggcagcccgattgcgattgacggcaagaccaagccgttcgcgcagtcgcgcgaatcggagatcgcgctgaaattcgacggcctcgacgtgccgaagctgatctcgtacgtgcccgcgaagctgccggtggccgtgacgagcggcctgctgagcagcgacctcaaggtcaatttcgtgatgagcggcgagacgcccgcgctgcgcgtatcgggcaccgtcgacctgaacgacgcgaaggtgacggaccgcgcgtccgcgccgctgttcgccgcgcgcggcgtgcatgtcgcggcggccagcctcgagccgctgcgcaacgcgttgcacttcgacgagatccggatcgaccagccggtggtcgacctgtcgcgcgacaagcagggcgtgctgaacgtcgagaagctcgccgcgcagccggcagccgcatcgaacgccgccgagggcaagccggcggcgccgggcgccgcggccgcttctgcggctgcggtagccgccgccagcggcgcaaaggtcgaagccgccgcgaaggcggcgccgccgctcgacctgacgatccgccatttcgcgatcgacggcggcacggtcaacgtcgacgaccgcgtgccggcaacgccgaccgcgctgtcgctcacgaagctcgccgcgacgctcgacggcttctcgatgcagggcaagacccccgcgaaatacacgctgtcgacgtcgctgtcgcgcggcggcgacgtgacggccgaaggcacgttcaatctcgcggagaagcaggccgacagcaagctgacggtcgccgccctcgcgctgccggcgctgcaaccgtacctcggcgaggccacgcgtgcgcgcgtgctcgacggcacgctcggcgccaccgtcaacgcgaaggccgactggggcaagacgccgctcgccgcgcaggtcgccgacagcacggtcagcctgaagtcgctgaagatcgcgacgcccgacgcgaaggcgcccgcgatcgtgttgcccgacgcgagcgcgaagatcgcgaaggtcgacgttgccgcgcgcaccgcggagatcgcgagcgtcgacgccagcgggctcgcgctcgacgtgcagcgcctgaaggacggcaggatcgacctcgcggcactggccgaacccgcgcaggcgtcggtgccgaagcgcacggtcgcgcgcaaggccgaggccgccgcgccgtcgtggcattaccggatcgatgcgctgaacgtgaaggattcgtccgcgaacttcaccgacctgtcgacgccgcgcccggtgaagctggcgatcaagccgctggacctgtcggtgcagaagatcagcgacgacatgcaagccgctgcccgtgcagttgaaggcgacgctgaaccgcaagggctcgctgaacgtgacgggcgacgtgaccgcgcagccgctgaagctcggcctgaagatcaacggcaaccgcctcgacgcggccgcgttcgagccgtacttcggcagcgcgctgaacgcgacgatcgccagcgcgctgctcaacgcgcagggcaacctgacgttcgcgcaggtgaaggacgcaccgcgcgcgacctatcgcggcgacgtcgcgctcgtcgacgtgcggatgctcgacaaggcgacctccgacccgttcgcgggctggcgctcgctcgcgctgacgaacctgaaggcgaactacgacgagaagggcaccgacgtcgacgcggcgcgcgtgacgttctcgaacttctacggccgcgtgctgctcgatgcgcagggacggctgaacctgaaggacgtggtcgcgaaggagacgggcccggcgcagtcgctcacgcgcgacgcgagcaagggcgaaccggtgccgctgtcgccgggcgtgacgccgccggctgccgccgcgcagcaggcgtccgcgccggccgccgcgtcggcgacggtggtcgtgaaggccgcgcagccgccgcagaacccggtgcggatgcattttggcgagttgctgttgcagaacggccgcgtcacctacaccgacaacttcatcaagccgaactacacggcgaacctggtcgcgatcaagggcacggtcggcgcgttcggcacggattcgacgacgtccgcgccggtcgacgtcgccgcgaacctcgcgggcaacgggccgatctcgatcaagggttcggtgaacccgctgatcgagaagccggcgctcgacctcaccgcgaccgcgcacgacatcgagctgaccaacctgacgccgtattcggcgaagtacgcgggctacccgatcacgaagggcaagctcaacgtcgacctgcattacgagctcgcgaacgaccgctgaaggcgaacaaccacatcttcatcgaccagctcacgttcggcgaccatgtggagaacgacacggcaaccaagctgccggtgaagctcgcgatttcgctgctgaagaacacgcgcggccagatcgacgtgaacctgccggtgtcgggctcgctgtcgaaccccgagttcagtgtcggcgggctgatctggcgcgcggtgctgaacctgatcgcgaaggccgtcacgtcgccgttctcgctgctcgcgcatgcgttcggcagcggcggcgaggatctcggctacgtcgaattcgcgccgggctcgtaccagctcgacgacgcgcagcagaagaagctcgataccgtcgtgaagatgctgaccgagaagccgtcgatccgcctcgacctgatcggccgcgtcgacccggcaaaggacacgtcggggctcggcgacgcgtacgtcgagcggctggtgcgccagcagaagctgaaggacgtgatcgggcagggcgagagcatcgacccgatgtcggtgaaggtcgagccggccgagtacagcaagtacctgacgcgcgcgtacaaggccgccgacttcaagaagccgcgcaacctgatcggcctgcagaagacgctgcccgatgccgacatgaagaaggcgctcgccgaacacgcgccggccgacgacaacgcgctgcgtgcgctcgcacagcagcgcgcgcaggccgtgcgccagtacctcgaggggaagatcgattcgagccgcgtgttcgtcgtcgcgccgaagctcgatgcgaagggcatcgacgacaagggcgcgaccacccgcgtcgatttcggcctgcagtaagcaggccgtccgccgccgccgcgtccgttcctccgttcgggcgcggcggcgcgctgccttcagcgcgcggcgatcgccggttcctcgcgcttgcccaattccttcttcgcggccagcggcaggcgtgcatcgtcccactgcgccagccattcgacttccttcgcggtgaacacctgtccgtagttgcgcaacgcgtactgcaacgcgtcgacgacgtggtggcgaatgatttcggggtgcgtgcatcgtccagcacgaaccggagggcttccagggtcgacatactcatgctccgggtcagggaaaacctttatcacacgccaatagtcgcgcgccaagccggaaaatcgtgcggcgggtgacgccgcggacggtggccgatgcaccggggcggtgcttgccggtgagcgcgcgagtccgcaacgtgcgcccggccacgctggtttgcgaccgcgtcgtgtcacttgcgattggttacgtttgatagaaaacagaaagccccgcttcatgcgagcgacccacgacgcagccatattcttgcgcgcctgatggcaagtcacgcagttcaacgtcaatcgatgaggtggggtgatcatgtctttccttgggaagcagcggaagtgggtggggatggtggcgggcgcgctggcgctcgcaggcgcgggcgcgcatgcggcgcagcaggacggcaaccgtcagggcgcggaccgcggccacgcgaaccgcgtcgtgaagcacgtgctgctgatcagcgtcgacggcctgcacgagcaggatctcgcgcgctgcatcggcgcgaacacgtgcccgaatatcgcggtgctcgcgaagagcggcgtgacctacacgaatgcctatacgcccggcctgtcggattcgtttccgggcctcgccgcgctcgtgaccggcggctcgccgaagacggccggcctgttctacgacgtgtcgtacgatcgcaacctgtacgcgccgggcgacacgagctgctcgggcaagcagggctggaacgtcgtgttcgacgagacgaccggcatcgacgcggagaacggcggcgcgctggttcacctgaacggcggcggcgcattcaatccgcaggcgatcccgaacgcgaaggtcgacggcaagtgcgtgccggtctatccgcacaactacgtgaagaccaacacggtgttcgaggccgtgaaggcgggcatcccgaacgcgaccaccgcgtgggccgacaagcacgcatggggctacgactggctgaacgggccgtcgggcaccggcgtcgacgatctcgcgcgcaccgagatcaactcgatcgacccggcgacgcagacggactacacggacgtctattcgcataccgcgcaattcgacaacctgcacgtgcaggcgctgatcaaccagatcaacggccgcgactcgacgggcacgaagcgcgcgccggtgccgacgctgttcggcgccgatttccagacgctgagcgtcgcgcagaaggcggtggtgacgaagggcggcggctacctggatgcgaacttcacgccgaacgggcaggtcgcgaacgcgatcacgtacgtcgacaacgcgatcggccatgtcgtcgaggcgctgaagcaggcgaacctgtattcgtcgacggccgtgatcgtcacgtcgaagcatggccagtcgccgaccgatcacacgaagctcgtgaagaacggcgacacgctgacgaagctgctcgaagcgaacaactatctcgacccgaacggcaacttcggccagaacaacacgaagacgggcaacctgaacgacggttcgggcctggtcggcacgggcttcgtgcagaccgacgacgtcggcctgatctggctgcgcgaccgcaaccagcgcacggccgtggtgcagacgctgaaggcgaacctgggctgcaacgcgccggggatctgcgcggacggcccgcaggcgtacatcctgtacggcgcggcgctcgccgagcggttcggcgatccggccaacggccgcacgccggacatcatcgtccagccgaatccgggcgtgatctacacgtcgagcacgaagaaggacgaggagcacggcggcaacgcgccggacgacagccacctcggcctgctcgtgtcgtatccgggcctgcatcgcgcgcgcacggtgaccgacacggtcggcacgaagcaggtcgcgccgacgatcctcgggctgctcggtgccgacccgcgcctgctgcatgcggtggtggccgagaataccggcgtgctgccggggctcggtatcggtcgctgagcgacgcgacgccgcaggactgcccgccgccggccgcgcggcgggcggccggtgtgtcgcgtgaagtgctgcgcgaggtgctggccgcgtctacttcgcgaacagcaccggcatcatctgcagcgcgcaatcgtgcatgcgcttgccgatcgcctgcacgtccggctcgtcccgcgccatgagcgaatcgcccgcgcgtttcatcgccgcataactgccgtgcatggccgcatacaacggaatcggcgacgtggcgccggggcgggcccttcgaaatagccggttgcggcgagttcgcccaggtagtaggtgtacagcgcaccgacgtggttagcctgcagccaccccatcagctggatacgccggtagaccgacacgaggtcgtccttcgggcgcgagccgagcgcgacgaagatctgcagccgcgcgagccagttgcccttgcgcgcggcctcgacgagcgccgtccactgcgcgggcgtcgtcgagccgggttcgcgcaggctgctcatgtagtcgatcacggcctgctggtccggagccgggccgatctggtcgggcgacctgcacacgaagcgggacacgtcgatgtcggcatcgccgagattgtcgagctcgtgcttgatcttgccgtacacgtcgtcgagctgtttctgaacgtcgtccctcgaccattcggcaggcagcgggcccagccacacgagttcgtcgtcgttggccgccgcggccgcgcggtaacgggcgagcgcggcatcgcggcgccgggcggccgcggcctgctcgtcgcgcgtgtcgtcggccatgcgctgcgcgaccaggttgacggcgtcggtcagtttcgcgcagcgggcgaaggcggcgtcgcggcgcgcccagcacgcgttgtcgaccgtgtagatccagcgggtgttgacggtctccagcacatagtgcgtctcgcccgcctgccgtgcgacggcggcatgcccttgtcatcggtcacgcctcgggacagcaccttgccgtcgtgcgtggtccagctgtagggctcgctgctcagcggtatttcgctgccgctgtcgccggtcaggttgatcgcgtagtgcgtcgtcggcttcgtttcggcgtgcgcgacgccgacgacggtgagcgcggcgagcgcggcgagcgcgacagccgcgcagcggtgccgggccttcttcggggcgtgatggcgggcggctcgtggccgtggtgtgacgacggggtgttcattgccctctttctccgttgttgttctcgtcgtgcttcgttcgacgacgcgcgagtgtagcaggcgggtatcgcgacgaacggcttgaattctgtcgcccgtaccggcatattcgccacgcatcacccgttcaacgacgcaccgagaggtttgttcatgcgccttctgcttgccctgctgctgccgtggttccagttcttcacgatcggccgcccgatcgccgggatcatctgcctgatcctgcaaatcacgatcatcggctggctgccggccgcgatctggtcggtgtatgcgctgagccagtacaagaccgatcgcaagatcgaagcggagctgcgcgggcaaaagtaagcgcccgggcgattccccgataccgggcttcgtcgatccggcagcggaagcggcgagttccgtgcgcgtcgtcggctatcccggcggcgcccttccagcgcctccgcccgcgcgaacagccagtcgacgaacgtgcgcagcgacgcatcgccgtcgtcgcgatacaggcagtgaaacggcggcccttccaggtggacttccggaaacagcgcgacgagccgcccgtgctcgagatcgtcgcgcacgaccgcacgcggcgcgaggcacacgccgagcccgctcgcggcagccttggtcatcaggaagaactcgcgatagaacggcccgcgcagcgtctcggtgacgaccgagcccgcctggtggaaccagtattgccatgcctgcggcaagcccgcgtaatgcagcagcggcgcgttgcgcaggtcggccggcgtgcgcgcgtcatcgagcaccgggtggccgggcgcgcacaccggcaccgccacggtcgcgagcagcggccgcgacacgaacccttgcggcgcagctccggcgtatagcggcggatgacgatgtcgcaggtttcgtcgaactggtcgcgttcggtgtcgggcgtcgtgacgagttgcacgtcgatatccggatgcccggcctggaacgcggccagttgcgtgagcaaccatccatgcgcgaacgacaccgacgtgttgatccgcaccggatggccgccgaccggttcgagcatctggctcgtggcctgcgcgagccggccgaggcagctcgcgacgtcgacgaggtaatgccgcgcgcgcggcgtgagccgcaacgagcgcccgtcgcgttcgaacagcttctgcccgaagaacgattcaagcacgcggatctgctgcgcgaccgcgctctgggtcacgttcagctcgtcggcggcgagggtgaggctctgcaggcggccggcagcttcgaagctgcgcagcgcattcaggggcggcaatcggcgcatcgtgagatcgcgaagaaaagctacacagtgggtcaaaaatgtcgtttgtggcggccggggcgcctccctatcatggcgccgacaggagagaacgccccgatgacgatcatatcgccacccgacgcccggacaaccggatttcgccaccgtctacgcgtcctgcgcgcggcacgtcgtgcgacgaaccgcccggccgcggtgccgcccgtgcgcggccgcggcgcgctggcgctcgcctgtgccggactgttcgcggcgttgaccggatgcgcgacgaaagccgacaacgagcggcagatcggcaacggcggatcgctggtgcgctacagctcgagccagaccgaagtcgatctgaccgatgccgagcagcagacgctgcgcatgctcagcgaccgccgctatgcggacgcgacgcaggcgcgcgcactcgacgcggtgggccgcgctgcgcgcgcagggttatgcgccggtgacggtcgatcgcgattcggggctggtggaagcggggcgcagcgacacgctgatcccgaagtggcgtcagcgctgcgcggcgcgctgaaggcgcgcatcgggatgctgccgacgaagcccgatcatgaacgcgtggccgcgatcgtgacggttcgggcggggcaggacgcgcacgtcgcgatcgtgcgggcgcgattcgatcgtacggtgtgggacagcgccggcgattcgcgtaccaagaccgtcatggagcccgagtactaccaggcgttcttcgcggaagtggacaaggcgatgtgcgcgacgaagtgcgagcggtgagcgggtgcgcgccggcgcgtgaaagcgtgaatgccgggaggaggatcgccacggcggcgtgccggcggcgacggtggcgcgccggaggcggattgcgcggaacgggcccggcatgcgccccggcgtgcaacgcggaaggggcctacttcacggcaaacagcgtcaggttcatgaagatcttgaacgcgtaaccgagcgtgacggcgccgattacgccgccggccacaggacgacgaaccacatccagccgcgcatccgcggccgggggccgcggcggcggagtgttcggcggaatcagtggtggtagtaatgctggtcttcatggcgcaccttgcctcggaatacccagtaacccatcgtcgtgtaggcgatgatgatcgggaggataaccgctgcgccgaccagtgtgaaggtctggctggagcgcggcgccgcggcttcccagatcgtcatcgtctgaggaatcgcatacgggaacagcgtgacgagcaggccgacgtagccgagcagcacgagcgccagcgcgagcacgaacggcgtcatgtcatgccggttgcgcaccgcgcggcgcatccataccgcgcacgccgcgaccaggaacggcaccggcagcaggcgccagaacagccccgaatcgaaccagcgctgcgcgatggccgggtcctgcagcggcgtccacaggctgacgaccgcgatgaagccgagcagcacgagcgtcagcggccacacgacgcgatggaggcgccgctgcaggtcgccttccgtcttcgcgacgagccagcagcagccgagcagcgcgtaggtcacgatcaggccgaggccggtcagcaggctgaacggcgtgagccagtcgaaggcatcgcccgcgaacacgccgtccttcacgttgatgccctgcaggaacgcgccgagcgcgatcccctggaacagcgtcgcgccggccgagccgccgatgaacgccagatcccacagctgcttcgtgcgccgcgccttcgcgcggatctcgaacgacacgccgcggaagatcaggcacaccagcatgaagatcagcggcaggtacagcgccgacagcacggtcgaatagacgaccgggaacaccgcgaacagcccggcgccgccgagcacgagccacgtctcgttgccgtcccacacgggcgcgaccgtgttcatcatcaggtcgcgttccttctcgtccggaaagaacgggaagacgatgccgatgccgaggtcgaagccgtcgagcacgacgtacatgaagagccccaatgcgatgatcgcggcccagattacggtgacgtccataggttttctcgtatgcggaatggggtgggctcagacggtctcgatcagctcgtcgacggccgacatcgggcggcgcgcggtgtgatcggggcgcgtgtcgggtgtgtcgtcgtgcttcacgtcgggcagcgcggggccggccttcatcagcttcagcatgtagtacacgccggtgccgaacacgaggaagtacacgatcacgaacgtcatcatcgacaggctgacctgctgcaccgacagcggcgacaccgcatgcgcggtgcgcatcacgccatacacgacccacggctggcggcccgcttcggtcgtgacccagcccgcgagcagcgacacgaagccggtcgggcccatcacgagcgcgaagcgctggaaccacttcgattcatacaggctgccgcggcggcgcaggaaccacgcgagcgcggcgaggccgatcatcgcgatgccgaggccgaccatgatccggaagctccagaacacgaccgtcgagttcgggcggtcttccggcgggaattccttcagcccgcggatctcgccgtcccagctgtgcgtgaggatcaggctgccgaggtgcggcaccttcaccgcgtagcgggtcgtttccgccttcatgtccgggatgccgaacaggttgagcgcggtgccgcccttctcggtttcccacagcccttcgatcgcggcgatcttcgcgggctggtgcttcagcgtgttgatgccgtgctggtcgccgatcacggcctgcagcggcgcgagcacgagcagcagccacagcgccatcgagaacatcttcttcacgcccttgtcgcggcggcccttcagcaggtgccatgcgcccgtcgcggccaccaccagcgcggcgacgatgaacgcggcgatcgccatgtggaacaggcggtacgggaacgacgggttgaagatgatcgcgaaccagtcggtcggcacgacgcggccgtcgacgatctcgaagccctgcggcgtctgcatccagctgttcgacgcgagaatccagaacgtcgagatcagcgtgccgatcgcgaccatcagcgtcgcgccgaagtgcgcgcgggggctcacgcggttccagccgaacagcatgatgccgaggaagccggcctcgaggaagaacgcggtcatgacctcgtacatcagcagcggcccggtgacggcgccggcgaagctcgagaagcccgaccagttcgtgccgaactggtagctcatcacgacgccggaaacgacgcccatcccgaacgcgaccgcgaagatcttcgaccagaacaggcagagggttttgtagtactgcttgccggttttcagccagcgatattcgaggacggcgatgaagctggcgaggccgatgctcagcgccggaaagacgatgtgaaaggagacggtgaacgcgaattgcaggcgggccagatcgagggccgaaagagcggtgtccataccagttgaccgaggctgacgatacccgccggcgggtgccggcggaccccggcggacgggcgtcggggttggctggagtatgggccgcgatgttgcaccgcgaaatgcgccaactcgtcgcagatgtccagcccggcgcgcgcgattccggggtaaatcgttgattcgtatcaagaaggctgcttgcggcgcgcgcggccgcggcgtggcggtctgacgcacgtgcgtcaatatggcgcgtcgcgtcatcggaacggttcgatccgggcgcgaacgctgcgcgacaccgcacccctcggcgcccgcgcgcggccgaaccgttgcggtgcgttatcgcgtaacgcacccgcccgtgccggcgggccgcgggtgatggggtctgtcacatcggtaacgccgcgcaacattggcgcgtgcgcccgtaatggatgacggatcgcgcgcggcgtagcgttcggtatgtcgggttcgcatcgacgaaccgccagccggagaacgtgacgtgaatggattgaagctcgcactgggcgcggtggccgcagtggcgatcgcgacgggtggtgtggcgcatgccgcccgggtcggggtctatgtcggccccggctacccgtattactaccccgtcgtccctgcgccttattactacccgccgcccgtcgtcgcggtacccgtcgccccggggccgccgcccgagtacgtcgagaaagggcagccgcaggacgacggcgacgcgaacgtctggtactactgcgacgcgtcgaagcattactacccgcatgtgaagacctgcaagtcgggctggcgatcggtgccggcacggcctcagtgacggaggcgcgacgatgaaatccctgtttcgaccactgcgcgtgccggccgcgctggcgctggccggcctgctcggcgcgtgcgcgtacatgccgaccgggccgagcgtgatggcgctgcccggcaccggcaagtcgttcgaccagttccgtgccgacgatgcgaactgccgtcaatacgcgttcgagcaatcgggcggcgtgagtgccggcaggcatcgaccgcgagcgcggtcggcagcgcggccgtcggcaccgcgctcggggcggcggccggcgcggcgttcaacggcggcacgggtgcggccgtcggcgcaggcgcggggctgctcgcgggcagcgtggtcggcgccggtgcggcgcaaggctcggcctacgacatccagcgccgctacgactacggctacctgcaatgcatgtacgcgaccggcaaccgcgtgccggtgccgggcgggatgagcggcggcggtgggggcggtggatacggcggtggcggatacggcggcgcaccgcgcgcggcaccgccgatgccgccggcgggtgtccagccgccgccgccgcgctactgacggcggcccgggcggcggcgtgccgcatcgcgtgccggtgcgccgtgctcgcgtcgaccgtcggccgtcggcacacacgctgcgtgaattgcgtacactctgagtctcgtttcggcagggccgggcgcatcggttccggtccgcgtttacccaggactcagcgatgatcgatttacgcagcgataccgtgacacgtccgagccaggcaatgctggccgcgatgactgccgccgaagtcggcgacgacgtatggggtgacgacccgaccgtgctgcgcctgcaggcggtgatggccgagcgggccggcaaggaagccggcctgttcttcccgagcggcacgcagagcaacctcgccgcgctgatggcccattgcgaacgcggcgacgagtacatcgtcggccagctcgcgcacacctacaagtacgaaggcggcggtgcggccgtgctgggcagcatccagccgcagccgatcgagaacgcgccggacggcacgctgccgctcgcgaagatcgccgcggcgatcaagccgatcgacaatcactttgcccgcacgcgcctgctcgcgctcgaaaacacgatcggcggccaggtcttgccggaaggctatgtccaggaagccaccgcgttcgcgcgcagccgcgggttggcgctgcatctcgacggcgcgcgcgtgtgcaacgccgccgtcgcgtcgggccgttcgatcgccgagctgtgcgcgccgttcgacaccgtgtcgatctgcttttcgaaagggctcggcgcaccggtcggctcggtgctggtcggcaaccgcgtgctgatcgagcgcgcgcagcgctggcgcaaggtgctcggcggcgcgatgcggcagtcgggcattctcgcggccgcgtgcctgtatgcgctcgaccacaacgtcgagcggctcgcggacgatcacgcgaacgccgcgcatctcgcggcaggcctcgcgcgcatcgacgcggtgaaggtgctgtcgcacgcgacgaacatggtgttcgcgcaattcccgaagccgattgcgcgccgctcgaggcgtggctcaaggaacgcgggatcctcacgcagatgctgtacgcgtcgcgcttcgtcacgcactgcgacgtgtcgcgcgcggacatcgataccttcatcggtgcggtcggcgcgtatttcgcgcagcgccgcgcgtaacgggaatgcgccggccggcgggagagccggcacgaggtggcgcgaagcagggagcgaagaggcgacggggcgacggggcaacccgtctgtcgatatcgggcgagccggcggattacgcttgccggggtgcgtcggcgggggcgtgccgtcgcggaacagcgctttcagttgcgtgcgcagttcggcgctgtcggtgtgctggtgcaccagcaccgcgtgttgcacggcggcctccagcagttcgttgtcggagtcggcggaaatcgcgaccgagcaatgcgtcgcgctgggaaactcgcggcaatcgatatagcggcgggacatgatgttctccttgcgggaaagggaacggccggatgtgcgtgatcggccgcgcggcgcgttcgcgaggccgatggaaaaagtataggcggcgcggcagggtttctcgccgcaatgcgtaccgcgccgcgcgccatgcaccgccctggcggtgtcgatcacccgcgcgtcacggcagcggcgcgagcagccggcgcgccgcctcgacgacgcgttccgacaacgacgccatcgtcggcgactgcacggtccacgcgtgccagtacagcgtgacgtcggtcggatgcgcgggcgcgagatcgacgagcccctgcgcgtcgagcggcgcggcgccgatcagggctccggcaccatcgcatagccgagcccgtgccgcaccgccgcgaagtgcgaatgggtgcccggcacgtagtggcacgggtaggcgccctcgggcagcccgaacttctccttcaggaacgacgactgcagcgtatcgcgccgcgagtacgcgacgacgggcgccttgcgcgcgctcgtgcggttcagcccgcgcgggaaccagcgcaccgcgaacgcggcggccgcgagcagccggtagcgcatcgtgccgagcggcgtcgcgaggcagccgcgcatcggcttcggctcggtcgtcacgcagcccaccgccatcccgctttcgagcagcgcgaacgtgtggtcctggtcttcgacgatcagctcgaacaggatgcgctcgccggcgagtacggacgtcagtgccgggagaaaccacgtgccgaggctgtcggaattgagcgcgatcgtgaccgagatcggcgattcgcgctcggtcgcgagcgtgctttgcaggtcggcctgcagcagcgcgacgcggcgaaggtgctgcagcacgcgctgcccggccaccgtcgggcggcacggccgcgtgcgcagcacgagcggcgtgccgaggcttgcttccagtgcgcggacccgctgcgtgacggccgatgcggtcacgtgcaggcgcacggccgcctgctcgaagctgcccgtgtcggcgacggccagcagtgcggcggcctgcttaggatcgatcgtcatcgacatgtcggtggcattcctgtgaacgtaagacgagaggagccgctagtgtaaggcagcccgcccgcgcgcccggttgcggcgcatcgtgctgccgtgccgcattggtcgtcgggaatcggccgagacatcgcgcacaccgcatcccggtggtgcgcgcattttgaactaggctatatgaacgcgcggaacccgggcatgtgccatgcctgcactccgcgcgcggacgatcgcgcgtcgcgcgcaagccgcggcgcgggcgtcgtgacgattcccatttgacggagacgaacatgtcgattcgactaggcgaggacgcgcccgatttcaccgcggagaccaccgagggaacgatccgctttcatgaatggatcggcgaccattgggcgatcctgttttcccatccgaaggatttcacgccggtatgcacgaccgaactcggctacatggccgggctcaagccggaattcgacaagcgcaacacgaagatcatcgggctgtcgatcgatccggtcagcgatcatcggaagtgggtggcggatatcgccgagacgcagggtcacgcggtcaactatccgctgatcggcgacgacgagctgaaggtcgcgaagctgtacgacatgattcatccgaatgcgagcggcggcccgcgcacggcggtcgacaacgcgaccgtgcgctcggtgttcgtcatcgggccggacaagaaggtcaaggcgatgctcgtttatccgatgagcgcgggacgcaatttcgacgaggtgctgcgcctgctcgacgcgttgcagctcaacgcgcagcatacggtggcgacgccggtcaactggcggcccggcgacgacgtcatcattccgacgtcggtgtcggacgatgcggcgaagcagaaatatccgcagggcttccggacgctgaagccgtacctgcgttacgtgacgcagccgggctgacgcgccgtgccggccggatgccggcagtgcaggaccacgacggggcggcgcgcggcggccgcggcgacagcggcggcgcgggccggacaatgcgcatcaaccagcgacggagcgacttcgcgatgatcttccggcaactcttcgacccgcaatcgtcgacgatacgtacctgctcgccgaccgcgcgtcgcgcgaagcgctgctgatcgatccggtgttcgagcaggtgcgccgcgacgcggcgctgctcgacgagctcgggctgcggctcgtcgcgaccgtcgacacgcacgtgcatgccgatcacgtgacgggcgcgtggctgctgaagcagcgcacgggcagcacgatcgcgatctcggccgcgagcggcgcgcagggcgccgatcgttacctgaacgacgacgaccgctgtgcgttcggcgcgcgctacctgaccgtgcgcgcgacgcccggccacacgagcggctgcatcagcctcgtgctcgacgacgaatcgatggcgttcaccggcgattgcctgctgatccgcggcaccggccgcaccgacttccagcagggcgacccgcgcgcgctgtatcgcgcggtgcacggccggcttttcacgctgccggccgcgtgcctgctgtatccggcgcacgactatcgcgggctcacggtgacgagcgtcggcgaggagcggcgcttcaatccgcgcctcggcggcgatctgagcgaagacgatttcgcgggctacatgcgcaacctcgggctcgcgcacccgcgccagatcgatgtcgcggtgccggcgaatctgcaatgcggcgtcgccgcgaacgcgcccgatgcgcaggcggcacccgactgggcgccgctcgtctatacgttcgccgggttctgggaaatcgatccgcaatggctcgaggatcatttgcaggcggtgcaggtggtcgacgtgcgcgagccggacgaattcacgggcccgctcggtcacctgcccggcgcgatgccgattccgctcggcgaactggccgcgcgtgccggcgagatcgcgcgcgaccggccggtcgtgaccgtgtgccgggccggcgggcgatccgcgcaggcgaccgtgatcctgctgaaagccggcttcgacacggttgccaatctcggcggcgggatgctgcgctggcgtgccgaggggcgcgtcgtgatggacggccggtcgtaacggcacaagtcgcacgacaaaaattccggaccgctgtcgaaacggccgggtgccgttcgtcgtcaaggtatccgatcacgtggcgccgcacgacgcggcgccgaaacccgagagaccgcacgatgataccgacgctttacgcccatccctttcgtcctactgccagaaggtgctgaccgcgctgtacgagaacggcacgcccttcgcgtatcgcgtgctcgcgcacgacgatccgaagccgatgcaggaactggccgcgctgtggccgttgaagcgctttccggtgctggtcgatgccggccgcaccgtgatcgaggcgtccatcatcatcgagtacctcggcctgaaccatccgggccccgtgcggctgctgcccgacgatccgcacgcggcgctcgaggtgcgcacgatggatcgtttcttcgacaactacgtgtcgacgccgcagcagaaggtcgtgttcgatgcgctgcggccggaagccgagcgcgatgcgcgcggtgtcgccgatgcgcgcgcgatgctcgacacgtcgtatgcgtggctggacaggaagatggccgatcgcgaatgggcggccggcgaccgcttcagcctcgccgactgcggcgcggcgccgttcctgttctatgcggactggacgcaccggatcgatccgtcgttcgcgaacgtgatcgcgtatcgcaagcgtctgctggcgcggccgtcgtttgcgcgcgcggtcgacgaggcgcggccgtatcgcccgttctttccgctgggcgcgcccgatcgcgactgaacggcgcgggcgtcgcgcggcgcgccgacgccgcgcatggccggcagcgcgtgccggggcgacggaacgaaagcagcggcagcatcgcggcgtctcccgttacatcgtgcgggtggccgactgcgcgagcgtcagcagttcgtcgaactgcgtgatcagctcgaagcacagcaggaacgcgagcgtataggccggcgcggggaagcgccggattgtcgccagcacctgcggcgcgaagcgcgagcggatcgcgtcgcgcgtcagcagccatgcgatcgcgatgccgatcgcggcgccggcgatcaggtcggtcgggtagtgaaagccgagataggcgcgcggtacgcagatgaacacgaccgcatacagcagcgcgagcacgccgacgcggcgcgcgatgatgaagatgccggtggcgatcgccatccacagcatcgcgtgatcgctgggaaacgaactccatgcctgtagcgtggccgcgcgcagggctgccgacggaagtgcaggtgcagttcggggttgtagatcggccgcacgcggaacggcagcacctgggcgagcagccggccgaacgcgagcgcaatgagcccgctcgcgatcgtcgcgacgaccagctcgcgctgccgctcgcggttcgggcccggctggaaccacagccagcacagcacgggaatgagcacgaagcccttgaacgtgtacaggcccgcgatcacgcggatcgcgtgattcatcagcggtccgaacgtgatgtgggtgaggaaggtctggatcgtggtatcgaaattgttcatgtcgtgcgatcccggcggacgcccggtgcatcgcgcgcggccggccggatctggaagcgcgctcgcacccgagcgcaacgggggcaagtatgtcacccgttatttcgaagaaaatgcgaaaaataccgggaatccctgatgaaacggggctgtgcgatggggccggatgggcgagcgccgtgtggcggggatcggaatcgtccgatatttccgcgtcgatgcgcgcggtcatcggaaaaataatcggtagaactggacagtcgcgcgggctggtgtggatcttgcactggatgagcggttctcgcgccggatgcgcgcgaatctgccgggccgcgcggcgtcatgcgtgcgccgatcgaaaataaagaaaaggcgggcaagccctgtgggcctgcccgccacgtgcgtgcggtgcggaaattcggcggcgccggattcgtgccgtgagcgccgggcggccgcggcgccgtcagccgcgccggatgccttcgggcagtgcgctgatgcggcgcacttcgggcgaatcgagccacgcgcgcgacgtcgcgcagtcggcgaacatgtcggtcgcatcctcgccccagaacaggtcgccgtcgagttcgaaggtcggcacgccgaatacgccgtgcgcgatcgcatcgtcggtgttcgcgcgcagcgcgtcctgaccggctgggcttcgacggccgtcacgccctcgggaagccgacggcttcgcacagtgcggcgaagccttccggcgtcgacacgtcccggccgtcgcgccagatatgccggaagatccggcggatcgcgtcgggtgaactgcccatcgcgatcgcgagacgcagcggcctgatcggattgaacgggtgcgcgggcggcatccggaacgtaatgccgagcttgtccgcgcgatattgcgcgtggcgataggtgaagacgcgtttcgccgcgatctcggccggcgctttctggccccagcgtgagagcagtgcgccgagcacgatgggccgcggctcgaacgcggcggcggccggcaaccggtcgaattgttcctgctgcaggtaggcgaatggcgacacgaaatcgaaataccagatggcggtgcgcgcggcgttcatggtggctgccctcatgggtgtccggttggcggtggcatgcgcggcacgcccgcaggcggcgcgcgatgcatgcatcggcggccagtgtcgcacgcggctgccctttgcgttgttgctgtagcgctgttgcgtggcggggcgcgcgccaccggtcatgacgccgtgtcgccgtggcccgctgccggcgcgaactgcgcgaggctgtcacgtacggccgccgcatcgtagcgcgcgcctgcgccgccgagcgccacggtcgccttctgcgcgagcggcagcagcatcgcgagcgctgccgccatggccggtgcggcggcgagccgcgatttcgggcccgacacggtcagcgcgccgacacactcgccggccgcaccgaacacgggtacggacgccgaagccgtctcggggtcgcgctcgccgtacgacgcggcccagagtcgttcgcgcacgtcgtgccattgcgcatcctgcgtgtcggtgaacgccagcagcaccttcccggacgcgccctggcgaaccggaaattcctcgccgacacgaatcgacacgcgcaccgcgcgggcgggctcgacccggtacagcaccgagcgcatatcgccctggcgcacgtagaacgatgccgtttcgccgagttcgcggctgagcgtttcgagcagcggctcgaccaccgggccgacccggaacgaacgctggtacagcgcggcgagccgcagcggctcgtgcccgatcgcgtactggccgtcgtcgagcttgcgcatgaagccaccatgctcgagcgcggcgagcaggcgcaggatcgtgctcttgtacagcccggtgcggcgcgacagctccgcgagcgacagccggtcgtcggtctgcccgaaggcgcggaggatcgcgaacgcgcgatcgaggacggcgacgccgctggacgcttcttcggccggcgaatcgggctcgctgccggcgtgatcggtgtgagtcgtaggcactgcctgcttccttcagaggatgatcggtcgactatatcgttctgcctgacagaactcaagttccagaaaatcgcaatttcgcgggtatacccgcttacagcacgttcgacgcacgcttagagttctatcaaacagaacgatgttctttcagatagaacgatggagtatcaaatgagcgtttccgaatatccgaaggtgctggtcagcgaggtcgggccgcgcgacggcctgcagagcatccgggccgtgatgccgacggccggcaagctgcgctggatcacggcgctggccgcggccggcttgcgcgagatcgaggtcgggtcgttcgtgccggcgaggctgttgccgcagatggccgacgtgcgtgaggtcgtcgcgcatgcgctggcgattcccgggctgcatgtcgccgcgctcgcgccgaacctgcgcggcgccgagggcgcattcgaagccggcgtgcacaagctgacgctgccggtatcggtgacggaggcgcattcgctggcgaatatccgcaagacgcccgcgcagatgatcgacgaggtgcgcgcaatcgtcgcgctgcgcgatgcgcggttcccgtcggtgcagatcgaggcaggcgtgtcggtcgcgttcggctgcacgatcgcgggcgccgtcagcgacgacgagacgatcgcgatggcggtggcgatggccgaatgcggggtcgacgagatcgggctgtccgacacgagcggctatgcgaacccggcgcaggtgcgccggctgtttgccggctgcgccgggaagtcggcgacaaagcgggcggcgcgcatttccacaatacgcgcgggcagggctcgccaacgtcgtcgcggcgctcgacgcgggcgtgacgacgatcgatgcgagccagggcggcctcggcggttgcccgtatgcgccgggtgcgaccggcaacatcgtcaccgaggatctcgtgttcctgctcgaagcgatgggatacgacacgggtatcgacgtcgacgccctgctcgccgcgcgcgatcctgcacgcggcgctgccggccgagacgttgtacggccatgtgccggacgccggtttgccgaagggcttccgttacgcggacggccgttctccagccgcgccgcaaccggaaggatgcctggcgggagtcgcgcaatgaacggccgccaacccgcttcgatgctgccgtacgccggcgtccgcgtgatcgagatgacgcacatggtgatgggcccgacctgcgggatgctgctcgcggatctcggcgcggaagtcatcaagatcgaaccgatcgccggcgacagcacgcgcgcgctgcgcggttcgggcgcgggattcttcgggatgttcaaccgcaacaagaaaagcctcgcggtcgacgtgaaggatccgcgcgggctcgagatcgtgctgcggctcgtcgcgacggcggacgtgttcagcgagaacttcaagagcggcacgatggaccggctcggcctcggttatccggcgctgcactcgctgaatccgcgcatcgtgtacgtgtcgcacaagggcttcctgccggggccgtacgagcatcgcaccgcgctcgacgaggtggtgcagatgatgggcggcctcgcatacatgaccggcccggaggggcggccgctgcgcgggcgcgagcgtgaacgacatcatgggcggcatgttcggcgcgatcggcgcgatggccgcgctcgcgcagcgcgagcgcaccggccgcggccagcaggtgcagagttcgctgttcgaaaacaacgtgttcctcgtggcgcagcacatgatgcagttcgcggtgacggggcaggccgcatcgccgatgccgagccggatttccgcgtgggccgtctacgacgtgttctccgtgaaggacggcgagcagatctttctcgcggtcgtgtcggatacgcagtgggcgctgttctgcgatgcgttcgggctggctgcgctgaaggacgatgcgcgcctcgcgaccaacaacctgcgcgtgcaggcgcgcgagtggctgctgcccgaactgcgcgcgcggctcgcgccgcattcggccgcggagatcggcgcgatcttcgagtcgatcggcctgccgtatgcaccgatcaccaagccgcaggacctgttcgacgatccgcacctgctggcgacgggcggcctcgcggacgtgactttgccggccgatgcgagcagcgccgggcggccggtcgacacgcgcaccgcgctgctgccgctcacgctcgcgggcgagcgcctgcggctgcgctcggcgccgccggcgctcgggcaggacacgcgcgcgctgcttggcgaactcggctacacgccggacgaggcgcgcgcgctgatcgaagccggcgtcgtggccgggcggcacgacgcggacggcgcggcggcgggcggcgcgccgtcgccgaacgaactggcgagcgcgtagcgcggccgcgatccctgatcgaacaaaggcgtcccgaccgcgccacgcgcgggcgaggatcgccctatccacggagacaaccatgacatccgcattcccggcgctggccgccgatcgcgagaccgatgcatcgatcgagcagcgggccgtgcgcaaggccgcatggcgcttcatcccgctgctcgcgctcgcgtatttttcaattacctggaccgcacgagcgtcgggttcgcggcgctcacgatgaaccgcgatctcgggctgacggcgacgcagttcggctggggcgcggggatcatgttcgccggctactgcgtgttcgaggtgccgagcaatctcgcgctgtaccgcttcggcgcgcgccgctggctcgcccgcatcatgatcacgtggggcgtgatggcggccgcgaccgcgcttgcgaccgggccgacgagtttctatgcgatccggttgctgctcggtatcgggaagccgggttctttccgggcgtgatcttcttcctcgccgtgtggtttccggcgagctaccgcacgcgggtgctggcgtggttcaccgtgtcgacgccgctgtcgtcgctgatcggcgggccgctgtcgacgtggctgctgcagctcgacggcgcgctcgggctggccggctggaaatggatgttcatcgtcgaagggctgccggcgtgcgcgctcggttttctcgtgctgaagctgctgtccgattcgcccgcggatgccgcgtggctgtcgagcgacgagcgtgccgcgctgcaacgcgcgttcgagcgcgaaggcgcggccgccggccgcaagaagcgcttcggcgtcgcgctgcgcgacgtgcgcgtgtacgtgctcgcgctgatctcgttcggtttcacgatgggttcttacgggatcggcatctggctgccgcagatgctcaaggcgcacggcatgtcgacgatgcagacgggctggctgtccgcggtgccgtacttcttcgcgaccgtcgcgctgctgtggtgggcgaagcgcgtggaccgtcgcggcggcccggtcgcgaacctggcgatcgggctgttcatcggcgcggtggcgctcggcgtctcgacgcacttcctgacgctcggccccgcactcgccggcatcacgctggcgctggtcggcacgatcgccggccgcacgatcttctacacgctgccctcgcgcttcctgtccggccaggcggcggccggcgggctcgcgctgatcaactcgatcggcgcgctcggcggcttcgccggcccttatctcgtcggctacctgaaggacggcttcggcacctttaccgccggcatgttcggcctcgcgatcgtgctcgcgatcacgacgctgctgacgctgtcgctgtatgcgttcgaccggagcgaatgacatggacacgacgctttcgatcaagcggcgccggctgctcggcgcggccgccgcatcgctcgcgctgcccgcgttcgccgagacgcgcgcggcgacccaggaggagtttcccgcatgacgatgcaaagcaactatctggcggtccgccccgactggctcgcgtcggcgctcgaacccgtgctcgagcccgacctgccgatcgtcgacgcgcatcaccatttctatgagcggccgggctggatctacatgctcgacgactatctgcaggatgcgcgctcgggccacaacctccaggcgtccgtctacatgcaggcgcagacgcgctatcgcgatgcgggcccggtcgaactgaagccggcgggcgagacggcctacgttgccggcgtgaccgagccgttgcagcagcacggccgcccggctgtcgcgaaaggcatcgtcggccatgcggacctgcgtctcggcgagcgcgtgcgcgaggtgctcgaagcacatctcgaagccggacgcgggcggtttcgcggcgttcgtcacctgacgacctgggatgccgatccgacgctcgccaatccgctatcggcggtgccgcgcggcatgctgctcgattccgcgtaccgggcgggcgtcgcgcagctcgcgccgctcgggctgtcgtacgacgcgtggctgttctttcccagctacctgaactgttcgagctcgcgaaggcgaatcccgatacgcgcatcatcgtcaatcactgcggcggcgtcgtacggatcgcgagttatgccgacaagcggccggaggtgttcgagcgctggtcggcgtcgatgcgcgcgctcgcgcagctgccgaacgtgtacgtgaaggtcggcgggctcgggatgcgcatcaacggtttcgatttcgagaaaggcgcgcggccgccgtcttccgtgcaactcgccgacgcgtggaagccgtggatgatgacctgcatcgacgcgttcggccccgagcgctgcatgttcgagagcaattttccggtcgacaagggctcgtattcgttcgtgaacggctggaatgcgttcaagcgcctgacggcgcaggcaagcccggacgagcgcgacgcgctgttccgcggcacggtcacgcgggcttaccggctcggctgacgcgcgtcgcgacgacaggcccggcgcttgctcactccgcttccaccagcgccgccagcctcgccagcgccatttgccagccggtttcgttgtcggcgaccggcacgccgggcggcacccgtcgtgcacggcgtccacgcgcgtgccgcccgcttcgtcggacagcgtgatcgtgatcgtcatggcgccgcgcagcatcggatcgtcggtttcgaacacgtcgatctcgacgatctgctcgtccggcacgagcgtgacgaagcggccgtgataggtatcggtgcgcgcggtggtcttgccggtgccggccgacggtgcgtcatagctcagcgacacgcgcagcgcgccgccttcgcgcgcgtcgtacgcatgcacgcggcacgtcatgccgtcgggcaccttccattgttcgacggcgtgcggatcgagcagcgcgcggtagacgcgcccgcgcggggcgttcaggtgccggctgacccgggtcgaatgcgtgtgcgtgtgcaacatgtcgcctcccgcggagcgcgcgacggtgcacgccggcggccggcgtgtcgtcgcgcttccttcaggaatcctaggcgcgcacgaggcggcatgcaatgatcgcgcacccggccgcgctcagcgcagcgcggccgcgaaggcgtcgagctgcgtgatgcaagtgttccagccctcgaagaagccgagcgcttcatggcgctcgcgcgtggcggcgtccggatgcatcacgcgcgcctcgtagcggctgcccgcatcgtcgtcggccatcgtgatgactgccgtgaaccccagccacggcacttgcggccgccagccgcccgcgagcatcgacgtgaacgcgatgcgcgattcgggcacgatttcgaggaagcagccggggttgtcgctcgtgccgccgtcggggccgcgcatggacgtgtggaaagcgccgcccggacgcaggtcgaatgcgcgcacttcggtggtccacggtttcgggcaccaccattccttcagcagttcggggtcggtccacgcacgccacagcgcgtggcgcggcgcgtgcaacgtgcgcgtgatgacgagatcgtgggcttcagcggggtcgacggggctggctgacatcgtgctcctcctggtgacggcgttcgacgaattcgacgagacgatcggatcgtgcttcccacagcgcgcgttgcgcggcgagccatgcctcggcctcggcgagccggctgccgaccagtgtgcaggtgcgcgagcggccggatttccgggtctgcacgaggccgctgcgctcgagcacggccacgtgcttcatgaacgacggcagcgccatgtcgaacggctcggccagtgcggagacggtccgctcgccctggccgagcgcgccgacgatcgcgcagcgcgtcggatcggcgagggcgtggaagacgtcgctgatgccgggttgaaagttagccatgtggctaagtgtaggcaatgcgaacggcgatgcaacggaaattttcgtcgcgtaggatgatggggcggtaacacgcgccgaccgggcgcggtatcgccgcatgcctgctgccgttgcgcgagccgcgacgatcggccggtgttctttccgatccggccgcccgccgaacccgtgcgggcggcccacctgattacggggatggcatgaccgaatccgttaccgtccgccgcgtcgacgcgggcgaagcgatgacctgcgtcgatgcgctggccgacgtgctgatcgattgcgtcgagggcggcgcgtccgtcagcttcatgttgccgatcgggcggccgaccgccgtcgcgttctggacccacgtcgcccacggcgtcgcgaacggcgagcgcatcctgctcgttgccgaggacgcggccggccggatcgtcggcaccgtgcaggtcgtgaccgcgcagccggagaaccagccgcatcgcgcggatatcgcgaagatgctcgtgtcgcggcacgcgcgccggcagggcatcgccgggcggctgatggcggcggccgacgcggccgcgcgcgacgccggcaagaccgtgctcgtgctcgataccgtgacgggcggcgacgccgagcggctgtacgagcgggccggctggcagcgcgtcggcgttgtgccgaactatgcgttgatgcccgacggcacgccctgcgcgacgacggttttccacaagcaactcgcgtaacggggcgcgcgatgcatcccgtcgctcccgcgctcctgttccttacgctcgcggccggtctcgtcgcgctgctcgcgcctgcgtggctcgcggccgcgtggcgacgccgcacgcaggtgccgcttcgcgtgtttttctacgggatgctgaccttcttcgtgttccagccggtactgcgcatgtcgtggcagattccgctgtaccgctggcttgctcacgacccgcgctggcacttgccgatgctcgtgttcgcggcattgacggccgggctcttcgaggaatgcgggcgctgggtcgccttccgatatctgctgccgaagcggcatgatgcgccgacggccgtgatgctcgggctcgggcacggcggactggaggcgatgctgctggtcggcgtcgggtttctcgcgctcggcacggcttatctgctcgcgcacgcgggtgtcgtggtgcctgagggcgtgcagtcgctggtcgggtcgcagttcgcgggcatgacgctcgcgtcgcccgttctcgcgttgctcgagcgcacgagcgcgctggccgcgcatgtggggctgtcgctgatcgtgctgcagacgttcgtgcgcggaacgaagcgctggctggtgtatgcgattgcgcttcatttcgtgttcgacctcgttgtcgtgctgctgacgcggtactggcatgtcgatacggtgctggtcgaggcgaccctgttcgtgtgcagtgtcgtgctcctgttgctgggcattcgctggagccgccgggcggcgggtgccggaggcgcgagcacggggcacgtcgcgtgacgggcagggagcgtgtcagccgtttgcagcggattcggccgccggatggcgggcgcatctgattatccaggcggcatcagcgggtaaaggtccccggttcgacgaaacggcagatctcaacggcaagcgccggaatgtctccccggtcgcggcgagcgcagggcccggggcgaccgcgctccgtccgggaatcaggcagggccggagacgtcgccagtccgatatagtcacgcaggaagatttcagcagcacgccccggaacccccgcctcgatgaaacgctcccatatcgtctacgccctcacgggcctgcttgtcgcgctgccgattgccgcgtatgcgctggtcaagccgctgcgcgtcgtcgcgcctgcgctggtccccggcgtgtcgtgcccgagcgccgatatctgcacggacgatgccgcgaggctcggcgacgcacggcagctctatcgcgacggttatgcacgcgcggcggcagccgtcggtgcgttccgggaggcgccgcgcgtcgtgttctgttcgacccgcgcgtgcgccgatgcattcggcctcggccagcgcgcggcgctgacgctcgggaatttcggcgtggttgtcgcaccgcgcggctggcagacctactttctcgcgcacgagctgatccatcaccgccaggcggaagtgctcggcaacctggccgtcgtgaccaagccgcgctggctgatcgaagggatggcgtattcgctcagcgacgatccgcgccatccgctggcggagccgttcgaagcgtggcgcacgcgtttcggcgcatggcatgcggcgctgggcgggcagccgctgtgggaggccgcgcgggcggtcgaatagcggggcaagggcgccgagcgcgccgtcttgccccgccgtctgcccgtcatgccggcgcgaccggatcgtcgcgcccggcggtgagcgcgttccgccccgccgcgaggatttcgtcggccagcgcgggctcggtgccggcgatcgcgcgcgacagcacgagtgcgccgaccatctggctgaagacggcgatcgcgtcgcgacgcgtttgcgccggcgtcccgccttcgacggccaccatccgttccagccggtcgagatacgtggcgaggccgtgcgcgtagcacgcacgcgccgcatcggtcagtcgcggcgcatcgcccgcgaaaccggacagcgggcacccggcctcgacgttgtcgcgatgcgcggccgacagatacgacgccacctgcgcgtcgagactgccggcgttcggcgaatccgcgcggtcctgcatggccttttccatcacctcggcgaccagcgcgtctttcgacttgaagtggttgtagaagccgccctgcgtgaagccggcttccttcatcagctccgtgagtcctaccgcgtcgacgccgcgcacgcggaacagccgctcggcggccgcgacaatcgcgctccggttctcggcagcctgctgtcttgaaacgcccatcgatccctccctgatttttgctgatcgcgtcgattgaaaattacaatggcgaccaccattgacatgagtggattgcgtgaacacaatgcacggcaaagacaatggtgatcgacattgacatcgagtgtagccgacttggcggagggtgcaaagccgctgccggaacggccgatggcaatcgatcggcgtcttgggcgccgccggggcacgtgtatcgggcaacgggcggctcgccgtctgccggcggcgtaccggttcggaacgcaatggcagcctggtttttcaccggatctcacgcgcgcggcgagccggcgcgcatgcgattcatcatgcgaaaggaagcgtcatgaagatcgaaggtgcagtggtgttcgtcacgggtgcgaatcgcgggctcgggctcgagttcgcgaagcaggcgcttgcgagaggggcgcgcaaggtctatgcggcggcgcgcgatccggccaccgtgacgctgccgggcgtcgtgccggtgaagctcgacgtgaccgatccggcggccgtcgcggcggccgccgacgcggcgcgcgacgtcacgctgctgatcaacaacgcgggcatcgcgcgactcggcagcctgacggacgacggtgcgaccgacgcattgcgcgaccatttcgaaaccaacgtgttcgggatgctggcgatgtcgcgcgcgttcgcgggcatcctcgccggccatggcggcggcgcgatcctgaacatcctgtccgtcgcgagctgggtgaaccggccgatcctgtcgggctacggcgtgtcgaaatcggccgcgtgggcgctgaccaacgggctgcgccattcgctgcgcgagcagcgcacgcaggtcgtcgggctgcatgccggcttcatcgataccgatctgacggccggtctcgacgtgccgaaggcgacgccggccgacgtcgtgcgccaggcgtacgaagcgatcgaagcaggggaagaagaagtgtcgaccgacgagttcacgcggcaggtgaaggccacgctgtcgtcgggcgtctatctggaagaaccggcgccgcgttgacgccgccggaacctcgaacccgcctcccgcgccgcgtgtgcggtacgggcggcgggtcgggccgtcaggccgtggtgtcgatgatgcccgggatcttcacgtccgggttcacgtccgcgtcgtagtcgacgccggcgatctcgaagccgaacaggcgcaggaattcggtcttgtagccggcgaagtcggtcagctcgtacaggttgtcgttcgtcacgtggttccactgcgcgacgaccttcgcctgcacctgcggatcgagctccttgtaatccgcgcgcaggcggccttcctcgtcgacgtgcggcgtcgcaccgtacaggctgtccttgaagagcccgtacacctgctcgatgcagccttcgtgcgtgccggtttccttcatcgtcttgaacagcagcgacaggtacagcggcatcatcgggatcgccgagctcgcctgcgtgacgacggccttcagcaccgacacgcgcgcatcgccgccgtgcgcggccagcttgtcgcggatcgacagcactttcttgtcgagatccttcttcgcttcgccgatcgagccgttccagtagatgtcgtgcgtgatctgctcgccgagatacgtgaacgcggtcgtcttcgcgccgtcggccagcacgccggcttcatcgagcgcgtcgatccacatctgccagtcctcgccgcccatcacggcgacggtgccgtcgatctcttcctgcgtcgccggttccagcgtgacgtcgcggatcacttccttgtcggtgtcgaggccgcggaacgtgaccgtcttgccgatcggcttgagcgtcgagctgatggtttcgcccgtcttcggatgcgtgcggcgcggcgccgcgaggctgtagacgacgagatcgaccttgccgagatcctgcttgatggtgtcgatcgtgacctgcttgaccttgtcggagaatgcgtcgccgttgatgctgcgcgcatagaccccttttcggcggcgaatttctcgaacgcggcgctgttgtaccagccggccgtgcccggcttcgtttcgctgccggcgcgctcgaagaacacgccgagcgtgtccgcgcccgagccgaatgcggccgagatccgggcggcgaggccgtagccggtcgacgcgccgatcacgagcacctttttcgggccgttggcgatcgggccgtgcgaagtcacgtagtcgatctgttccttgacgttggcttcacagccgaccggatgagtcgtcacgcagatgaagccacgcacgcgcggtttgatgatcatggaaaccctctagtcagaaaggcagaaacggcctgaaatcggaaaaatcccgcgcattgtaatggaagcggccgatcgcgggcgggcgcggccggaacctggcggatcgtccggttatttctctcttgacagaaataactgaaatgcctaaatttcacgccatggaactcacaccgattgccgaacgattcattctccactggggcgaaatgggctcgcggtggggcgtcaaccgcaccgtctcgcagatccacgcgctgctgtatctggccggccggccggtcgcggccgacgagatcgccgagacgctcaacgtcgcgcgctccaacgtcagcacgagcctgaaggagctgcaggcatggcggctcgcgaaggtcgtgcatgtgctgggcgaccgccgcgaccacttcgagacgtcgaccgacatctgggaactgttcaagctgatcgtcgaagggcggcggcagcgcgagatcgagccgacgctcacggtgctgcgcgattgcctgacgaatccggagatcgcgaacgagagccgcgagaccgagcagcgcatccgcgacacgctgcagttcgtcgagacgctcacgacctggtcggacgagatgctgcggctcaagcccgatacgctgatgaaggcgctcggcatcggcgcgaagatcagccagacggtcaggcgcaagccgtcgaagtaagcgttacgcgcagtgcgggcaggcagcccgcttttttgggcttttatttctgtctgtacagaaataactgtaaggaggatgaaaatgaacgctgtcttgccgtcgacctgcccgcagggccgcaccgggcgcgccgcatgacggtcctcgtgtgcggcgcgaacggcttcatcgggcgggcactgtgcgcgcagctcgaagccggcggccatcgcgtgctgcgcggcgtgcggcatgcgaccggcccgtgcgacgtcgcgatcgacttcgccgccgacatcgatcccgacgcgtggctcgcgcggctgaagggcgtcgacgtggtgatcaatgcggtcggcatcctcgccgatcggcgaggcgcgacgctcgacgccgtgcaccgtgccgcgccgtgcgcactctttgccgcgtgctgccgcgccggcgtgcggcgcgtgatccagatctcggcgctcggcgtcgagcgcggcggcacgcgctacttcgccagcaagctggccgccgaccgcttcctgcagacgctgccgatcgacttccggatcgtgcggcccgcgctcgtctacggcacggacggcgcatccgcgcggtttttccggatgctcgcgagcctgcccgtgcaggtgttgccggcgggcggccgccagcggctgcgccccgtgcacgtcgacgatctcgccgaagtcgtcgcgcggctcgtcgtgcaaccgggcgatgcgtcggccgccggccgtgcggtgatcgacgtggtcggcaacgacgaagtcgaataccgcgagatgctggcccgctaccgtgccgcgctgagatttccgccggccgcccgcgtgacgctgccgggcccgctggccggcgcggcggccgcgttgctcggcacgctgccgggcgcgatgttcacgcgcgacacgtggacgatgctgcgtggcgggaacaccggcgatccggccgccgtcacgaccatgctcggccggccgccgcgcgggatcgacggcttcatcggcacggaggccgcggtgctgcgtcgcgacgcgctggcgatgtggcgtcgtccgttgctgcgcggcgcgctcgcgatcgtgtggatctggacggccatcgccagcgcgttcatccatccgctgcccgcgagcctcgcgctgctcgcgcctgcgcacctcacggggctgcccgcgctgatcgcgctgtacgcggccagcgcgctggatttcgcgttcggcatcgcgaccgtcgccgcgccttcacggcgcctgtgggcggcgcaagcggcgctgatcgtcgcgtactcggccgtcatcgcggtcacgatgccggcgctgctcgccgagccgttcggccccgtgctcaagaacgtgccgattctcgcgatcctgttgatcctttttcagaagaagaacaagcatgaatacctatctcgtcatcaaggcgcttcacatcctgtcctcggtgctgctggtcggcaccggcttcggcaccgcgttctacctctttttcgcgaaccgcacgcagtcggtgcccgcgatcgcggccgtgtcgcgcctcgtggtgcgcgcggactggtggttcacgacgccggccgtgatcttccagccggcatcggggctctggctcgcgcacaccgccggctggccgtggcatacgccgtggctgctcgcatcgatcgtgctgtatgcgatcgccggggcgtgctggctgccggtcgtgtggctgcagctcgaacttgcgtcgatggcgaagctcgcccatgcgaacggcgacgccgcattgccggagcgttactggcgctatgcgaagcgctgggaactgctcggctacccggcgttcttcgcgatgctgtccgtctacttcctgatggtgctcaagccgatgtaagcgcgtggccgccgccgcacgggagcggcggtacggcgtgcgggaaagcagtcgatcgattcacgatgcacgcaaagacaagaaggaatgcgaatcatggaatcaagtgaactggtgctgtacttcgacggacgatgtccgttatgtgtcgcgcagatacggcgtctcggcgcccgcgacgcgcagcagcggctggctttcgtcgatatcgccgggccgggcttcgacccggcgccgctgggcgtcggcctgcccgcgctgaatcgcgagcttcatgcgcgtctgccggacggacgcatgctgaccggtgtggacggcatcctcgccgtccatgcgctgaccgggcgcggctggctcgtccggctgcttcgcgtgccggtcgtgcgcggtgtgctggcaccgctgtatcgccgcttcgcgcgcaaccggcacgccgtttcgcgctggctcggctatcgcgccgaagcggcgtgcgacgggccggcgtgcggtagcgaccgtgccgccgaacccgcggtcgatcgtcccgcacgcgatgacatgcgccgcatcgtggtgacctggatgtacggcgcggcgctcgcgcatctgctcgtcggcatcgccgttccgtgggcggccggcacgccgtggctcgacgcgtatcaccgcgtcatcgagttgcatttctgggcgggcacggcgcccggcccggcgcgcgcagcagatctggtggatgtcgctgatcggcgcgacggtgcaatgcgcgtcggtctggatgctggcgctcgtccacctcggcaaccggctgcgccggcgggaagtgtggggatggctgctggccggcctggcgatctgggcgccgcaggacatgctgttttcattgcaggcccgagtatcgggccacgtggcgatcgacgcggcggcactcgttgcgatggtgccgccacttgtgtggctgtggaggagggataccccatgaacaccttgcctgcttacgactgggcgctcaacctgctgatcgtgcagggcgcgatgggcgcattcgatacgctctatcaccacgagctcacgcaggatctgccgcacagcccgcgcgcggctcgagctggggattcacgcggtgcgctccgtgctttacggtctcgtgttcgcgtcgatcgcgaacgtcgcctttcacggcgcgtgggtcgcggccctcgcggcggtggtggtcgtcgaggtggtgctgacgttgtgggatttcgtcgtcgaggaccagagccgcaagctgccggcgaccgagcgcgtgctgcacacgctgctggccgtcaacggcggcgcgctgttcgggatgatcgcgatgcagctggccgtctgggcgcacgagccgaccgcgcttcaggtactcgacctcggctggcgcggcgggttgctgagcgtgtttgccgtcggcgtgacggtatcgggcctccgcgacggaatcgcggcctgccggatcgcgcaacgcgcgccggccgccaatccgtttgcggggcagccgccggggaacgtgctcgtcacaggcggaaccggcttcatcggcgaaaccctcgtgaaccatctgctcgatgcgggccatacggtcacgttgctggcgcgcgacccgctgcgcgcggcctaccagtttcagggccgtgtgcgcagcgtgacgtccgccggtcaactgcagccgcacgagcgtttcgacacggtcatcaacctcgcgggggcgccggtgctgggcgcgcgctggagcaagcgccggcaggcggtgctgctcgccagccgcgtcggcgtcacggaatcgttgatgcgctgggtcgagaccgccgaggtcaagccccgcacgtggatccaggcgtcggcgatcggctactacggcgtgcggccttccgacgagcggctcgacgagcgcagcagcgccggcaccggcttcatgtcggggctgtgccggcagtgggagcagtccgcgcaggcgctcgagcgtcatggcgtgcgctcggtggtgctgcggctgggcctcgtgttcggccccggcggcgcgttgcgcccgatgctgctgccgcactacttcgggatgggcgggcgattcggcgacggcacgcaggtgatgagctggattcaccgggacgatgtgctgcggatcattgcacgcgcgatgtcgaacgcgggcatgcacggcgtctacaacgcggtcgcacccgcgccgttgacccagcgcgagttcgtgcaggtcgtgtcgaaggtgttgcgtcgccccgcgtttctgcacgtgccggccgcgccgctgcgcatcgcgatgggcgagatggccgcgctgctgctggacgggcagcgggtgatgccggcgcggctgcatcaggacggattcatgttccggttcccgacggccgagcacgcgctgcgcgacctgacgaaccggccgcacgcggattttccgcgtacggcatgtcgtttgccgcgccgtcgtgtataaattcggcgtgaatgcgttcgtggcgcgtcgtgcgccccgaacgctccgcatccgacctcacaaggagactgcatgctgcacatcctcggcaagattccgtccatcaacgtccgcaaggtgctgtggctgtgcaccgaactgaacctgccgttcgaacaggaagactggggcgcgggctttcgcgcgaccaacgatccggcctatctcgcgctgaacccgaacgcgctcgtgcccgtcatcaaggacgacgatttcgtgctctgggaatcgaacacgatcatccgctacctcgcgaaccgttacggcggcgacgcgctgtatccggccgagccgcaggcgcgtgcgcgagtcgaccaatggatcgactggcagggcgcggacctgaaccgctcgtgggtcggcgcgttcctcggcctcgtgcggaaatcgcccgatcaccaggatccggccggcatcgcgcagtcgatcgcaggctggacgaagcacatgcaggtgctgaacgcgcagctcgaaagacgggcgcgtacgtggccggcaacacgttcacgctcgcggacattccgatcggcctgtcggtgaaccgctggttcggcacgccgttcgagcatccggaattgccggcggtgtcacgctatatcgaacgtctcgcgacgcgcgaaggcttcaagcaatacgcgggcagcgcgaatccgtaaggccgggccggcagtgcgtgaagcggccgtgttgccatcgctgccgcttcacgcctgattcatcgatccacgtacccgtcgtcacgcgccgggcgccggcagcgcgtcgagcacgcgcgcaagaaacgcctcgtggttccacgcggattccggccgcgacagcccgagccgcacgaccaccagttgacggctcggcaccacgctcacgaactggccttcatggccgaccgcatgaaacgcgtcggccggcatcgcgaccgcgtgcggatcgcgatcgttgaacggctccggcaccttgacccacagctgcgcgccgtattcctggcgcgacgactgcggcgtcgcgcgcgtcaggtagcgtacccagccgtccggcagcagccgctgcccgtcccacacgccgtcctgcagcagaagctgcccgaagcgtgcccagtcgcgtgcgctcgcatacatgtacgacggactgacgagtgtgcctgacacatcgggctcgaacaccgcgctgcgcatgccgagcggcgcgaacagcgcgcgacgcggaaacgcgagatagtcgtccccgctgccgcccagcgcctcgcgcatcacgcgtgcgacgatcgcgctcgtgccgctcgagtaggaccactgcgtgccgggtgtcgccgcgagcggcttcgccgatgcgaaccgcgcggtatcgggctgcgtgaacagcatcaacgcgacgtcggacagcgggtcgtcgtagtcctcgttgaattgcaggccgctcgtcatccgcagcagctcgtcgagcgtgatggccgcgcgcgggtcgccgctgccgcgccattctggcagcagcgccgacgtatcgggcgacagcttgtgctgcgcgacgagcgcgccgaccagcgcggccgtcacggtcttcgtcatcgaccagccgggcagcggcgtgtcggccgtgaagccgggcgcatagcgttcggcgatcacctggccgcgccacatcacgacgaccgcgcgcgtgcgccgcggtcgtgccggatcgggctcgtcgaacgcgcggtcgagcgcggtctgcagtttccgtgcgtcgatgccggccggcggcgtggccggcgcggctggtgcgggcggcggatcgggaggggcggcagcgcggccggcaacgcgccgggcgacggcccgatcgcgagcgtgcagccgagcccgggccggaagtcggcttcgcgtccggcgaagccggcgaaggtcgccacggcgcgatgatggtcgggatcgatcgacgggcgaaccagcttcagcagcggatgcacgccggccatgatgtcgacgtcgatcacggacgcggcagggcggcccgatacgtacacgccggaacacagcgccttcgccgcataaccggtcgcgaccggcgcgagccgggacagcatgtagcccgtgtagccgatcgcggcgacggccgcgagcgcgacgccgcgcaggatcggcttcttgaaggggatcgtcatgcgcgggtgtcctcggttgtctgaaggcggaacacgaaccggcagtgtcgcaggttcgggccggcggtggcaatcgcgaggggcggcgatgccgggcaacgtcgacagggcgcggattgcccggcctgtgcgaatcgtctgtgtcgatcgccgaggttgaacgagcgcgtgcggcccgttcaagcggcgcatcactgcgcgttgtcgtggtcggagcgcagggtccagatcgtcgcggtattcgtgtcgtcgtcgacggccgcgaattgcggctggcctttgcggccgtacccgaacgccaggccgaacgcagccccgggaacggtgtcgacctgaaattgcgcgacgaagcgcccgtccaccgtgaattcgacgatctcgctcggctgcagcgggtcggcgctgacgcgtcgccgttcgcggtcacgagatgatggccgttcggtgcgagcgccagcgcgacccggcccggcccggcaagttgaaatccgacccgtcgtcggccgataatcgtccggcattgcattcccgctttcccagtccaaccgatatcggaacccgacatgtcctacgacaacaacaacccgttcgccagaatcctgcgtggcgaactgccgtgcgtgaaggtcgcggaagacgacacgacgctcgcgatcatggatctgatgccgcaggccgacggccacgtgctcgtgatcccgaaggagccggccgcgcagatcttcgacttgtccggcgacgcagccgcggccggcatccgcatgacgcagcgcgtcgcggcggcggtgcgcgcggcgctcgagccggacggcgtgttcatcggccagttcaacggcgcggcagccggccagacggttccgcacgtgcacttccacgtgatcccgcgctgggaaggcgccgagctgcggatgcacgcgcgcgagatcgccgacgcggcgacgcttgaagcgctcgcgcagcgcattcgcgcgcgtttcgtgtaacgcggcgatcgcacgcggcacggcgcgccacggcacaccggccggccgtcgcgccattacctgtttcggcggtcatgcgaggtaacacgtgtaaccgccggcgaaactcggcccggccgacccggcgctagactcggcgcattgcttcatcgagcgacaggaagggcggatcgcctcttcgtgccggccgccgcacctcgcggcggcgcggcgttcgcgaggtgccattcgtctttcgcgccgggaatcgagccatgtccagacttctcattacgcttgccctgatcggcggcctgtccggctgctacgtcgcgccgccgtacggctacgcgcccgcgccggcctactacggctatgcgccggcgtattacgcgccgcctgtcagcgtcgggatcggcggcaacttccgcatccgctgacccggcaccgggcgcgggccctggccgccccggccagggtcgtggcgtcgtgccggacgatgcgcgcggattcgcgcgccgcatgacggcggcgcgccgcgcggcgtgtgcgcggttcctatacttcacaggaaagcgcactccggcgaggcagtcatgacagtcacccgcaaggtcgccgccctgtcgggcatctccacgctcgtttatctcgggctcgcggtgctcggcagcggcgggttcgcggccttcttctcgcatccgccgctgatcgtcgtcgtcgtcgcgacactcgcgatggccgtcgcggcgatgttcaccgaaggcaacctgagcagcggcgagcgcgagaaccgcgacaaccgctgggtgctcgcggcgttcggggtgagcgggttcctgctggcctacctgcccgcgctgaccgaccggctcgacttctggaccttcggcggcgacgcggtgcgctgggccggcgttgcgctctacatcgcgggcggcgtgctgcgcatctggcccgtgttcgtgctcggcaagcgcttcagcgggctcgtcgcgatccagccgggccatacgctcgtgaccgacggcatctaccgctgcatccgcaatccgagctatctcggcctgctcgtcaattcggtcggctgggcgctcgcgttccgctcgggtgtcggcgtgctgctggtcgtgttgacgatgatcccgctcgtcgcgcgtatccgctccgaagaggcgctgctgcgtgcgcaattcggcgccgagtacgacgcgtattgcgcgcgaacctggcggctgctgcccggcgtgtactgaccccttcatttttccccgaccgtcgtttccgggcccgctcacgacacgtgcccgatgtgttgccacgtgtgtcgcaaacgtgcgacgccccgcatggacgacccgtcgtcgcgcagggccggaacctcggcggagccaatgccggcgcgggtttgcgggcattctggtgcgggcgttcaggggcgcctgttcgtaaacaacttgttaccagaatgtcgacggcaaggacgcgggaccggtgctattcttcgccgcaagctcattgaaatgaattggtccgcggttcggcacaatgccagacccgacgtcgatcgattcagatcgtcgtaccgagcggaccttcgataaccagattgcgaacaaggaagaatacgggaatgtggaagaaaatcgcccccgctctcgtcgtcgccgcgctgaccggcgcgactgcgctgccggctctggcaggtgacatgaacaacgcgcttggcggcgcgctcggcggggtagccggcgcagcggtcggcggtgcgctcggcggcagcacgggctcggtgatcggcggcgccatcggcggcggcgcgggtggcgcggtgacgtcgaaccgtcgcgagcgcaccggcgcgatcatcggcggcgccctcggcggcggcgcaggcaccgcggcaggcaacgcgatgggcggccgcacgggcggcctgctgggtgcggcggtcggcggcggcgccggcgcggcgctcggcggcaacatgtcgcgcagctcgtacgagcgcgatcatggcgatcgtggctatcgtcaccgcaagcatcgtcaccaccgcgactgggactgatcgccgttagcgcggcacggtgcgcgaaccgcgcaccggcgcgtagacggcgtcggcttccgacgcgagattcggcccggcggcctgccgggccgccatcgccggccagaccggcgaacattttccggcttcaccagccgcggccggatgcccgatcgacgggccggccagttttcctcctcgcagcatttcccgttttccggctacaccgcctttcgcgacggaatgcgtctggggagcgtcgacatccttggcgttccgttcgaccccgttcgatcctcgttccgccccgttggcccgtttcagtccgacgacggctcatgatcggtgcgaagcggctcgcagccgtgcacgcttcggcgcacgccaatctgcgttaccggatgtatcgcgacccgcgtgcgcgacctgcgtgaccgcagttgcgtacccgcgcctccagcgccgccgacttgcgtttgcacggccccgcccgtcaggatttcccggatagccagaccgtggcgccgcgctccctcacgatgtatcgcgggtgccggcgggtagtgggaaatcgaatggaatccatcgcaacatttaattggtcgattgcgaacgacttcgctatcgtcggcgatgctcgcgtacggcgtcgaaccgtgccgccggccgcgcgtcgccgcatgaacggaagcgccacggcccggccgccggccccgcaagcatgggccgctgcgtccgatgaaccggacgaacccgtcgcgaagcctggccgaccgaacgaaggcgcgtgcgccttcaagccaccccggcaacgatgtcccgccgccgcatgcgtgccccacgcgcatgcgtgccgcccgatgccgttggcgcccggggccggaccaacccattgcctggatgcactatgtctaagacaacgtattacgcgccgcacggcggccacccgccgcagaccgatctgctgaccgatcgcgcgatgttcaccgaggcgtacgcggtgatcccgaagggtgtgatgcgcgacatcgtcacgagctggctgccgttctggacgaacacgcgcctgtgggtgatcgcccgcccgctgtcgggtttcgcggaaaccttctcgcagtacatcgtcgaagtgaacccgggcggcggcagcgacaagcccgagcaggacaagaacgccgaagccgtgctgttcgtcgtcgaaggcgaagccgagctgacgctgcagggcacgaagcacgtgctgaagccgggcggctacgcgttcattccgccgggcgcggactggacgctgcacaacgtcagcgatgccgcggtgcgtttccactgggtgcgcaagcattaccaggccgtcgacggcattccgctgccggacgcattcgtgaccaacgagcaggacgtcgagccgatcccgatgccgggtaccaacggcgcatgggtgacgacgcgcttcgtcgacatgagcgacatgcgccacgacatgcacgtgaacatcgtgacgttcgaaccgggcggcgtgattccgttcgctgaaacgcacgtgatggagcacgggctgtacgtgctcgaaggcaaggccgtctatcgcctgaaccaggactgggtcgaggtcgaagcgggcgatttcatgtggctgcgcgcgttctgcccgcaggcatgctattcaggtggccccggccgcttccgctacctgctgtacaaagacgtgaaccgtcacatgaacctgacgctgaatccggcgcgctgagcgctgcgtcggcagtcgaatgtaaaaacccgccggcgcatgccggcgggtttttctttgcgcggcggttgtacgggatgcgcatgtcgattccagggccggtaaccttgccgtcgcccgaacggcggcggtgcgggccatcccgtgcgtcattccttgcgtccgacgctcaacggcgcatcggtcaggcgcagctcatgcgcgaggtcgatcagcgcgcgcaaccgcgcgggcacgaagcgatggcccgaatagtagagccgcagcccgccgaacgacgggcaccacggcgccagcaccggcaccagcgcgccgctcttcagttcttcgccgatgaaccattcggaaatgaagccgatgcccagcccgaacaggatcgcctgcttgatcgcggccagttcgttgagcgcgaaccgcacgggcaggtccatctgcagcttctgcccgttgcgctcgagctcccagtgatagatgccgccgtgggccatgcgcatgccgatgctctggtgcttgagcaggtcgcgcggatggcgcggcgtgccgtggcgtttcaggtactcgggcgttgcgaccaccagcatgcggatatcgcgcgacagcgcgacggcgatcatgtcctgcggcacggcttcggccagacggatgccggcgtcgaacccctcggcgacgatgtcgatcaggcgcgactcgctcacgatgtcgatgcggacgtcggggtaacgctgcgcgtacggatggaacagcggccccagcaacagatgcgcggcccctgcggcgcgttgatgcgcagcgtgccgctcggtgtgtcgggcccggcggccgcatcctcgccggcgctcctgatctcggcgagcgcgggcgcgatgcgctccacgtagcgctggcccgcatcggtcagcgacacgctgcgtgtcgagcggttgaacaggcgcaccttcaggcgcgcttccagtccggccacggcgctgctcaccgccgtcgtcgacatgcccagctccagcgccgcgccgcgaaagctgctgcggcgcgcgacggccaggaccacttccagctcggtcattccggtgcggtgcatcgattgtcctgattttcgggatgagtcatcagagataagacggcttatcggaacagtaatgtattcctagactgcgtgtcatgacggcttgtcggatacgcatacaaggagtacgcaccatgcaacgcatcgaacagatctacatcgacggcgaattcgtgacgccacacggcgacgaatggtttgacctgcacgacccgagcaccgagcgggtcatcgggcaggtccgcctcggcgacgagcaggatgccgaacgggcgatcgccgcggccaaggccgcgtttcccggctggtcgcgcaccacgcgggaagaacggatcgccgcgctcgagcgcatgcgcgacgccgtcgtcgcgcgggaagacgacctgatggaggccgtcgtgaccgaatacggcgcgccggtcgagcgcggccgctggatggcgacctatccggcggacgcgatccggcaggccatcgccgcgctggagacgttcgcgttcgaggagcaggccggctcggcccgcgtgatcatgacgcccgtcggcgtggccggcctgatcacgccgtggaacagcgatgcggggttcatctgcaacaagctggccaccgcgctggcggcaggctgcaccgcggtcatcaagcccagcgagatgagcgcgatgcagacgcaggtcgtcaccgaggcgctgcatgcggcgggcttgcccaaggggtgttcaatatcgtcaacgggcgcggcgacgtggtcggcgacgcgatctcgcgcagccccgacgtcgcgaagatttcgttcaccggctcgtccgcggtgggccagcatctggtgagcgccggcgcggcgacgatgaagcgcgtgacgctggagctcggcggcaaatcgccgacggtggtgctcgacgatgcggatttcgcgagcatcatgccgctcgtgctgcaggcgggattcatgaacagcggccaggcctgcatcgcggggacgcgcgtgctggtgccgcgccatcggctcgcggaattcgaagacgcgatcagccaggcggtggcgcgtgtgcgctcaggcgatccgcgcgatgccggcaccgacatcgggccgatggtcagcgcgaagcaatgggagcgggtgcagcactacatccgcatcgggcaggaagaaggcgcggtgctgctggcgggcggtgaagggcggccggacggcttgcaggccgggtggttcgtgaaaccgacggtcttttcccgggcgaacaaccggatgcggatcgcgcaggaggaaatcttcgggccggtgctgaccctcatcccttacgaagacgacgccgatgcgatcgccatcgccaacgatacgcgctacggcctgagcgcgatggtgctgggcaaggactccgaacgctgcgagcgcgtggcgctgcagatcgattccggccgcgtgctcgtcaatacgctggcccacgagccgcttgcgccgttcggcggcttcaagcattcggggctggggcgggaaatgggccggtggggcatcggcgcgtatctggaacccaagaccctgatcgggagcgcaagccgggtcgcgtgagcaggcgctcgcattcgatgcccctgtacgccgtgcgggggcgtttgcgtctctcatgctgatgcatcacgcatgcatcaccggtgatcgggcgcgcaagccgggtcgcgtgagcaggcacttgccctcaatgcccttgtccgccgtgcggccgcgtttgcgtatctcgtgcggctgcacatcgcacgcgcatcgctggtgaaaaggcgcggccggtgattccaagcctcggaggtggaacggacgcatgcggcgcatcctgacgatgcgtggctgctcgcggatgccgctgcgttgcgcggctacaagccgagcgcgtgcgcggcgagctgcgcgaccgccagccgggtttcgggcagcaggtcatcctccatcagccacaccgccgacaggcctgcccacgccagaatccacttcagcagccgacggcgatcgagtcgcgcggcatcggccacgcacacgacgcgttgcgtgaagcgcgccggatcggccgcgatctcgtgcgcgggattgcagaacaggttcgcatagtcgaacgcacgatcgccgcgcagccctttcgggtcgatcgcgagccagccgcgatcgccgaaatgaagaatgttgtcgtgatgaatgtccccgtgcaggacgacttcgtcgacgggtggcccggccagcagctcgcgcgcgatcgttgccgagcaatgcagcacgccgttgccggcgttgtccgacagcagcgaacggaaccagtcgcgcagcggcacgaccgaaaccggctccggctccggctccggctccggctccggctccggctccggcgcgcgatgcgcgtgcagtcgggcgacgacgccgcatgcgatgcgcatcgtgtcgtcgtcgtgacccgatgcggacaatttggccagcgacggcgcgggctgcgcgcgctcgagcaggatcgcgtcgctgtcgtgctgccacacctgcgccgcgccgtgcccgttccaccacgtcatcagcgcgttgccgcgccgctcttcgtcgcaggtggcgaccttcagcatcgcgggccgcgcttgccagagaacgggcaacaggccgccgctcgcggtcaggatcgggccgccgtcgggtacgaggccccacaggccgaggtatcgatcgaacatcacacgatgctacaggcgaaacggatcgcgcgcagcgcggttcttccggccgcgtttgacgtgcccgcgcgttcgacgtgaacagcccgacaccctttcctaaataaaatttagccagccaaactttggctaaagaatgttccggtttcgcgcgatcccttcgacaatgcgcgcctttcgtgaccggtcggtgcatatcgcgcgccggccgtcgcagcatcgaagaaggagcccgacatgaccgaccacaccgcatccctccgccgccgcccgtgccgccgccgcgccgccgtcgcgcatggcgcacgctcgcgggcgcgctgctcggcctgacgctcgcgtgcgcgggcatcggcgcatggacgatcaatcgcatctggacgcagcgccgtccgtcgagcacctcgccgtctatcgtcccgcgctgccgctgcggatcttctcgcgcgacggcgatctgctcgccgaatacggcgtcgagcggcgcgagttcgtgccgctcgaacgcatcccgccgctgatgcggcacgcgctgctcgcggccgaggacgcgaagttctatcagcacggcgcggtggatgtcggcggcctcgcgcgcgcgacgttcgcgaacgtcgtgacggggcagccggggcagggcgggagcacgatcacgatgcaggttgcgcgcaacttctacctgacgcgcgacaaggtgctgagccgcaagctcgccgagatcctgatggcggccaagctcgaacgcgaatacagcaaggacaagctgctcgagctgtacatgaacgagatctacctggggagcgcgcatacggtttcgcggcggcggcgaacgtgtatttcggcaagccgctcgacgcgctgaacgcgggcgaggcggccgtgctcgcggggctgccgaaggcgccgtccgcgttcaacccggtcgtcaatccggcgcgcgcgaccgcgcggcgcaactacgtgctcgggcggatgcacgcactcggccagctcgacgacgcgacttatcgcgcagccgtcgacgcgccgatcgcgctggcgaccacgccgccgcccgggatcgtcgccgcgccgtacgtcgccgaacgcgcgcgccggatgatggtcgagcgctttcacgacgacgcctatacgctcggcctcgacgtgacgacgacgatctcgatgcgcgaccagcgcgcggccgaagcctcgctccagcatacgctgagccggcagccgggcgcgaagcgcgatgcgcgcaacgggctcgaaggcgcgctcgtgtcgctcgatgcggccaccggcgacatgctcgcgctcgtcggcggcgcggatttcaatcgcaacgtgttcgaccatgcgctgcaggcgtatcgccagccgggttcgagcttcaagccgttcgtctattcggccgcgctggagaagggctacttcccgggtgtgctcgtcgacgatacgcagcgcacgctcacccatgaggaaaccggcgcgcggccgtggcgtccgcgcaatttcggcaaccgctacgagggtttcatcccggtgcggcgcgggctcgtgcgctcgaagaacctggtcgcggtcagcctgatgcaggccaccgacgcgcgctacgtgcagcagcacgcggtgcatttcggcttcgacgcgcagcgtaatccggcgtcgctgccgctcgcgctcggcgcgggcgcggtgacgccgctcgaactcgcgagcgcgtacagcgtgttcgcgaacggcgggacgcggatggagccgcgcctgatcctgtcggtgaagcagcgccacggcggcgcgatgtacgaggccacgacgccggaaggcgcgcgcgtcgtgtcggcgcgtaacgcgttcttgatggacagcatgctgcgcgacgtcgtgaaggccggcaccgcgcgcggcgcgctcgcgctgcgccgcgacgacgcggccggcaagacgggcacgtcgaacgggtcgaaggatgtgtggttcgccggctactcgtcgggggtcgtcgcggtcgcgtggctcggctacgacacgccgcgcccgatggggcgcgcgaccggcgcgacgctggcgctgccggtctggctcgactacatgaagacggccgtcgacggacgcacgccggtcgatgcgacgccgccgcaggacgtcgcgctcgtcgacggtgatttcgtctacgccgaatacacgcgcggcacgtgcacggccgacgtgccgtcgtacatccgcagccgcttcgcctgcggcggcgcggcggcgcaggacgcctccgatgcgccggccggcagcggcaaacccgacgagccgatgcccgcggccgtcgacgcggccgagcgcgaacgcgtgctcgacctgttccgtaccgacgactgacgcgcaccatgcatacgctttatctgattgcgatcgtcgcggaagcgatgtcgggtgcgctgatgggcatgcggcgcgggatggaccgcttcgggctcgcgctcgtcggcgcggtgacggcgctcggcggcggcaccgtgcgcgacgtgctcctcggccactatccgctcggctggatcgcgcatcccgaatacctggtgatcacgctcgccgcggcaaccgtcgcatcgtgggccgcccggcatgtcgcgcgaatgaagacgctgttcgtcaccgtcgacgcgatcggcctcgccgcgttcacgatcatcggctgcgacatcggcgcgtcgaccggcgccgcgccgatcatcgtcgtgctggccggcgcgatcaccggcgtgtgcggcgggatgctgcgcgacctgctgtgcaacgagatgccgctgatcctgcgcgaggaactgtacgcgagcgtcgcgttcgtgacgggggcgttgtatgtcgggatgcagcatctcggcatcgatgcggacgcggcgaccgtggtcgcgctggcggccggtttctcgatgcggatgctggccgtgcggctcgggtggaagatgcggaccttcggcgcggccgacgtcgggcattgacgcgcggccgcgaggtggcgcggcggcgttcagtccggctgcatcacctggaagacattgccttccggatcgatgccgtcgagcaaccggtacgggaatccgtcgaagcgcttgacgtcgcgcacggtgacgccgtcgcgcgcgagacggtcgcgatgcgcgtcgatgtcggcgtcgatccggaagacgagcttcacgttgttcgtcgccgggttcgcattcgacggctcggccgcgtggcgaaacgccgggccggccagatgcaacgcgagttcgatcgcacccgcgtcgagcaccgcccattcaccgtcgatttcctcgatgacaggcagatcgaaatggcgttgatagaacaccttcagcagcgtgacgtcctggacgtacaggatgatgcgggtcatcggaagcggcacgggagtctcctcgaaagggaagcgcgaatgaggctgcttgaaagccgggcgcaccgatcgacggccgggagacaaccgggaagcggccgccccgcatgcacccgcggcgtcatgccgggaccatgaccggcggcgcaccgtcgccggtttccaccatcttcacggaaaacccgtagcactgcgcgatatgcgcgggcgtcatcacgtcgcgcggcgtgccgtgcgcgacgatcgtgccgtcggcgagcatcgcgatcgtatccgcgtgccgcgcggcgaggttcggatcgtggacgatcgcgagcacaccgagccgccattcgcgcgcgaccgagcgcacggtgtcgagcagccggtgctggtgcgcgaggtcgagcgcggcggtcggttcgtcgagcagcaggtagcgcgggccgctctccgttgcgtcgtcgtccggccatagctgcgcgagcacgcgcgcgaactgcacgcgcgcgagttcgccgcccgacagcgtcgtgacgtcgcggccgacgagcgcgtcggcgcccgcgcgttcgagcgcgcgccacgcgatgtcgcgatcgtgatgcgacgtcgcgccgctgcgccgcgcatgcggataacggccgagcagcacgatttcgtcgacgctgaacgggaaggccggttgcgcggcctgcggcagcaccgcacgcaggcacgcgaggcgcggcgcgtcgatgcgcgcgagcggttcgccgttcagcgtgatgtcgccggtcacgcgtacgccgttcggcgcgacgctgccggtcagctcgccggcgaaggtcttcagcagcgtgctcttgcctgcgccgttgcggccgagcagcgcggtcacgcggcccggctcgatcgacagcgacaggtcgcggaggatggcgttgtggcggcgcgcgacgtcgagatggtgagcggtcagcatggtcgtcgtgaagaaagggttacccgccgagcgcgccgcggcttttccacagcagcgccagaaagaacggtgcgccgagcagcgcggtcagcacgccgagcggaatttcggccggcgccgcgaccgtgcgcgcggcgagatcggcggcgagcgtcagcaacgcgccgagcagcgcggcgccgggcagcacgacgcgctggtcggggccgcacgcgaggcgcacgcaatgcggcgcgacgagcccgatgaagccgatgatgccggcgcacgataccagcgcgccgaccgcgagcgcgaccgcgacgagcacgcgccgcttcagccgctgcaccggcacgccgaggtgcagcgcctcggtttcgccgagctgcaacgcgttcagcgcgtcgcgttcgcgtgcgagcagcacgcagccgatcgcgacgcacggcgcgacggccgccagcgcggaccattgcgcgccgccgaggctgccgaggctccagaaggtcagtgaacgcagctgtgcatcgtcggcgacgaacgtgagcagcccgatcgccgcgccggccagcgcattgatcgcgatgccggcgagcagcagcagcggcaacgcgagccggccgcgcgacgcggcgagccggtagacgagcgcggcgaccgcgagcgcgcccgcgaacgcggcgacgggcaacgcggcggcgctcacatgtgcggcgaacagcgcggggccgagcacgatcatcgtggtcgcgccgagtgccgcgccgctcgacacgccgacgagccccggatcggcgagcgggttgcggaacagcgcctgcatcgcggcgccggccgcgccgaagccgctgccgaccagcagcgcgagcgcgacgcgcggcgcgcggatgtcgagcagtaccgcgcgcgcctgatgcgcggcggcatcgccggtcagcgcggcccaggcttccgtgagcggaatgcggtacgcgccgacgcacagcgcgacgacggacatcgcgcacacgagaacggcgagcgcggccagcgcgaacggcgcgaagcggcgcgacgtgcccatgcgcgcggcgccggagcgcggcgcgggcgacggtgcggggaagggcgaagcgtgagcgggcatcggggcgatccgggatcaggcgagcgcatccgacagccgtcggtgcagggtcgtgacggcgagcggcaggcgtgggccgaagccgagcaggaacagggcatccagcgacacgacgcgttgcgcgcggccggccggcgtcgcgccgaagccgggcgtggcgagcagcgccgcgcgcccgccgactgccgcgagcccttcgtcggaaatcagcacgacgtcgggcgcggcggccgcgagcgcctcggtcgtcagcggcttgtagtgatcgaaaccctgcatcgcgttgcgtgcgcccgcgtagcggatcatcgcgtcggcggccgtgcgctggccggcgacgagcgcctggttgccggtatggttcagcacgaacagcacgcgcggcggctgcgcgccgccgggcgcgcgggcagcgaccgcgtcgcgcgcggcctgccagtcgcggtcgaaacgttgcagcagcgcggtgcccgcgtcgcgcacgtcgagcgcctgcgcgacgcccgtgatcttcgcgcggaccgattcgacgtcgtgccgttcgtcgaaggtcgtcaccacgacgccggcgcctttcacctgcgcaatcgcggtgggcgggccggcttccgccgacgcgagcacgagatcgggccgcagcgacagcagccctcggccgacagcgcgcgctggtagccgactttcggcaaacgcttcgcggcatcgggatatgtgcaggtcgtgtcggcgccgacgagccggtagcgcggcgtctcggcaccgccgagcgcgaacgcggtttccgcgagcgcgccgccgatcacgaccacgcgcttcggcgcagccggtgcggcctgggcgagcacgctgccgggcagcgcgccggcgagtgcgccggccgccgcgcccgccagcatggcgcggcggcgcggatcgaacggtcgcgcgctcaccgcgcgcctccgcgtgctgcggccggcagcgtcgcgacgagcgcgcgccagtcgtcgcgttcgaccttgccgggcttgcgttcgccgaacagcagcgcgacgtggtcgccctgccggtcgaacagctcgagcgacgtgacgatgccatcgctcgtcggcttcttcacgacccacgcggcggcgatcaggtcctcgcgcacgtgcaggttgaagcccgggtcgagcacgttgatccacgcgccgacctcgcgcacgttcgcgaccgggcccgtatgaatctggatcatccccgcgttgccgacgaacaccatgatcggctggccgctttgggcggcctgttcgagcacgtggcgcagcgcatgcgcggtttcgaccggatacgcgtattgcggatcggcgaggcgcagcgcctgcatgcggctcacgccgaagcgctgcgtgatgccgaagaactggtgcgtgtcggtcatcgcgtcccacgcggcgcgaaacccgcgacgtcgatctcggtgtcggcgcgctcgggcgttttcggcgcggcggccgcgacctcgagtcccggctcctgtgacggcgcgcgccagcgctcgacgaacgcgtcgtacgcggcgtggtcgctgtgcgcgcgcaggtagaccttgtgaatcgcatgcccctgcgcgtcgaagaactgcaggctcttcagcgggccgtgcgcggtctcgtcgcgcaccgcgaacgccgacacccagtgacgatagaagatgcgcaggtcgatatcgccgagcgcgaggccgacgggcccgtcatggctcatctgcgcatattcgccgtccttctcgtggacggccgtgtcgttgcgcgtgagcgccattacgcggccgaggcgcggcatttcctcgaacatcgccggaaagcgcgcgtcgagccgcacgacgtgctcgccgacgaacgcggcgagcgcctcgccttcgctgacgccgagcgcctgcgcgacgtcgcggttgcgcagctggcgctcggtcttgagcttgatgaacgcgtcgcgcagctcggcggccgcgcgggccggcgtggccggttgaccgggaagggcggattgcatcatgtcggactccttcaagtaacggttggggtggcagcgcgggcggcgcgcatcagaaatccactttcatgctgacggcgaccgtgcgtccggacgacgtatacgcatcgagcacctgggaatcggctgcgatgccgcgcacgtccgaccagttccagtatttgcggtcgaacaggttgcggatgccgatcgtcgcgctcacgtgcttgttgaagcggtagccgccgcgcaggtcgacgacgaacgacgacggcggcgagaagcacgtcttgttcgaacagtcggacttgtcgatgtccttgtcgcgtttcgcggcctggaacagcaggtcggtctgcacgaaccagcgttcggtcggctcgtagcgcacgccgaacacggcggagaacgggttgacggtgttgagcggctggctcgctgcgccgtcgttctgcgtcgagcccttcgtgaacgccatcgccgtcttcagcgtgatgccgttcggcatcacccattcggcgcggccttcgaggccgtggatgcgcgcgtcggcgaagttcacgtactggaacacgaacgggtcggccggccggccgctgcccgcgatcgtcgtgcgcgagatgaagttgcggtagcggcccgtgaaagcggccgcgctgtagcgcacgacgccgtagccggtgccggccttgccgcgcagcccggcttcgaaggtatcgctcgtctcgggcttcaggttcggattgccgatcgacgtatagccgtacaccgggttcgagaagctgctgttcacctggtcgggcgtcggtgcgcggaagccgtgcgcgtactgcacgtacggaatgaccgcgggcgtgatctcgtagagcacggcgacgcgcggcgacagttcgttcgcgctggtcgacacggccttgccggtgaacagcggatcgttttcggtcgggctcagccggtacgtgtcgaagcgcaggcccggcgtgacgagcaggcggccgtagccgatctggtcctgcaggaacgcgccgaacagcgtgtagtcggtgtcggggaacgccttgttcgggaacgcttcgccgacgcccggcaccgtgccgtcgcgcaggttcgtcacgcgcgacacgctgccgtcgacgccgtacagcagcttgtgcgcgaacggcccggtcgcgaagccgctttcggcgaacgccgagccgccgaacgtgcgttccttgtactggttgtcgcgcgaacgcgatttcagcggcgcgccgcgcgtctcgaacgcgtactggtcctgcttcgcgtcctggtagtagaactgcacgtgcgcggtctggaaccagcggaacgcatcgtcgcggaaatcgtagtcgacgctgaagcggttgcgctcgagccggtcgttcgtcgtgaggccgagcgtgttcggcggattgatcgcggacagcacgtcggtgctcacgcgccgctgcaccgtttcggcggtgagcttgaacgtgtcgcgtgcggtgggcgtcagtacgagcttgccgagcagcgattccgaatagacgtcctgcgggttcgacgtggtgcgcagcgtgctcgccgagttgttgctgccgcgcgtgtcgacctcgtggccgcgccggccgtcggcgatgatcatcccctggacgcgatcgttgccgcccgcggccgacacggtcgcgccgatgctgcggtcggccgagtcgtagctcggccggaacgagaagtagtagggcttgttgtagatcgacagcaggtcgcgcggatccttcgtgatgaagttcaccgcgccggtcaggccgtcgctgccgtagagcgccgacgccggcccgcgcaggatctcgatgcgcttgagcgtgtcgagatcggcgtagtcaccgcgccccgcttcgagcgggccgaatgaaaacgcgttcggcaggcggatgccgtcttccatcagcagcacgcgattgccttcgaggccacggatgttgatgctcgaatcgccgtcgcggccgccgccgagcgcggcgctgccgggccggtacgcggtgcggcgcaccgtgatgcccggctcgtagcgcagtgcatccttgatgttggtggcctgctgttcctccagatcctcgtcggtgatcaccgagacggacgcagccgtgcggctcgtggccgttgcggtgcggttggccgtgacggtgacgggatcgagcagcgccgcatcgccgcgcgtggacgcggcaacgagcagggtggaaggcggggtggcgccttgcggcgacgaatcggcgtgagccggggcggcggacaggccgaacgcgccgaacagcgcggcacagatcggccgccgcgccagcgtatagcaatgcacaggtggtctcccattgacgaaaacaagcccgaaggctggctgggtgacgcgttcacctggctggcccgcccgcgcacggaatgcggcgagcggcgaattgaaaggcaactgacaattttgccagtgtaaatgagaattattatcaatacaagaacgaaaagcggcgcgcgtgggtgagcgctcacctgcgcggcgcgggcgagccgcgccggaaaatacggaagaaacgcgggccgtggagcaagcccgccacgagcgtgaacaggccctaggcgagtgcttcgatgcggatcagcaggttgcgcgcatgcgtgatgaacgcatcgtgcgtcgcgcgatcgccgtggccttcgaggccggcctgttcggcgaatgcgatctgctcggtgtagaggtcgacaagcgcgcggcgtgcatcagggaagcgcgcggaccatcgacacgatcagcagttcctgcgcgcgaagcgtgccggacagcgtctggacgttcatgctggcctcctcggacgatgcggcgacgagccgctctttccatactaggcggtcggcgtacgcagcgcaggcgaggcgtcggcggaatgcgattcgacggggcaatcgagggcgccgttgcgcgacgcgaaacgcgccgcgcgcggccgggcaccacggattgaagcgtgcagggatgtgaacggaatcagccggccgtcgttgcggcctgcgcatcgcgcacgacctgcgcgacgcgttcgacgaactcgacgtcgacgctcgacagcgcttcgcgcttgccgtcgggcatctcgaccatcaggcgatacgtgacgtcctgcgtggtccacgcgagatagccgacgacggcaagcatcacgccgacgacgagcgcggcgctcgatccggcgatgccgcccgcgacggcggcggccgcgccgatcagcgagatcagcgacggcacgaggcggtttttcggaatcttgacgacatcgacgtggcggatgtcacgcagcgcgaatacctgcccggcggccgacaggccgttgcgcgtgatcatcacgccgcgttcgttgaatgcgttttccatcgtgtgttgcgtggacgaaaacgcgcagcgtagcaggtttcgttgctgcatcaaacgagaccgactgccgcacgatgcgtgcggcgcgctcgaaagacgggcagcgggtggaacgggacggcgttcagaactgcagccggccgtcgccgtaaagccggcccggcacgtgcgacgcgacgacctcggcgatctcttcgtcggtcgattcggccggcacgatctggcgccgcgcgggtgcgtcgagatgcatcgtccattcgacgagacgatacggccgtccccacgggcgctgcatttcgaccgatacgcggcagctctggaccggcatcgagtgttggcacgtcagaatcgcgtgcagatggctgaaaacggtatcttcgatcatcatggcctccgatcctgtcttgtgggcaatcgatggcggcgccgtcggcggttcaaaaaagccgccgatgttcaggcggccaacagggggtgagagcatcctctcagcccagaattaagcgaaacttaaagcccataaaaagcgccccgcgtggagcgggcgcttcttccgtcgtgatccgcgagttaagcggatgctttagaacttgtgacggataccgatacgagcggcgatctggttcttcgaacccgtgcccgacgtgttgaagtagctcgtgctcgagccgatctgcgcttgcacgcccttgcccgatgcctgctggtacacgaccaggccgtacacgtccgtacgcttgctgagtgcgtagtcggcgataccgttgacctggttccagtgccacgaattgccattctgcgtcgcgttcgtgtacgtgtagcccaggccacccgacagggccggcgtgaacgcgtacttcgcgcctgcttcatacgcgttgtagaacgtgccgcccgcgcccgagacggtcgagaactgcgtacgcgtccacagcagccatgccgttgccgggccccagacgtagcggccgcccacaccgtaggtgcgcaggtcgcggacgttgcccgtgctcaggttcgcgatcgacgtcgagaaggccggcgtcgactggctcgggaagcggatgtccgtgtaggctgcgccgaccgacagcgggccgttcgcgtagttcaggccgaagctgtatgcgcgcgacgagcctgccgtcgtcgtcgtgcccgacgtcgttgccggtgcgccggcgaagtccgtcgagttcgagaagccgtacaacgcgccgaacgtgaagcccgagtagttcgcgctctggaacttcacggcgttgttgatgcggctcgacgtgagctggtcgatgtcgttcacgtggtacgcgtagttgcccgcgaccgtgttgccgcccgtcgagtagttcgagccgaggatgtcggtcgagaacgagtactggcggccgaacgtgaccgtgccgtattgcgactggctcaggccgacgtaagcctggcggccgaagatcgcgccgccctggccgatcgtgccgttaccgctgttgaagccgttttcgagcacgaagatcgccttcaggccgccaccgaggtcttcggtgccgcgcaggccccaacggctgccctgggcaacgccgtcgtcatacttgaacagcttgcccgagccgccgttggcggtcttgctgtggttcacgtagctgataccggcatcgatgacgccgtacagcgtcacgctgctttgtgcgtgcgccgtgccggccgttgctgccaggacggcgatggtcaacagtttcttgttcaaaggattctccgagcgaataaatggcgtgtccagttgcggttccggcgctctctgtgggcgctttcacggaccggcggcaactttatcgaggggccacgtaatgaatatgacagcgactgtcatatgaagaatgtgtggcgccgatgcgacattagggcctgcttgcatatggaacgtgcatgcgttgccacgagaacggccgctcgcgaggcgcgtgacgccgcgaatactgacgtattcgcaaggagcgcaacgcggcgagcggccgttctcgtggcaaccccaaactaaaaattcaatccacgggaatgcccgaaatcgcccgcatggcggcgtcgctcgtcgcttgtttggctcggccaaacggtgctcctcacttcttgccctgcgagcgatttcgggcattcgcatgtacgttccatatgcaagcaggccctaaattctgcccggttgtaccgtcgcgggttataccgaattcggctgagaatcgatccggccccggaatatgcacatgaaataagcttggttggtggcgttccggccccgtgccacgatccgtcttccaacaaacgacacgggacaagaggacaccatgcgacgttcattcctgaccggcctcggcgcgctcgcagccgcactggcattcgcggcgcccggcgcgcacgccgactcgcaaacgctgaagatcggcacgatgagcggccccgacgcgcagatctggaccgaggtgacgaaggtcgccgcacgcgaaggcctcgcgatcaaggtcatcgaattcaacgactacgtgcagccgaacgcggcgctcgatgccggcgacctggacgcgaacggcttccagcaccagccgttcctcgacagccagatcaagcagcgcggctacaagatcgtcaacgtcgggcttacctacacggcgccgatgggtttctattcgaagaagatcaagtcgctgaaggatttgccggtgggcgcgaaggtcgggatccagaacgatccgtcgaacggcaaccgcgcgctgctgctgctgcagaaatacggcgtgatcaagctgaagccgggcgtcggcaccaacggcgtgaacgcgacgccgctcgacgttgccgagaacccgaagaagatcaagatcgtcgaactcgactccgcccagttgccgcgcgcgctgcccgatctcgacgccgcgtcgatcaacaccgactacgcggtcaaggccgggctcacgccggtgaaggatgcgatcgcgatcgaggacctgcgcgggccgtacgcgaacctgatcgccgtgcgcgcgcaggacaaggacaagccgtgggtgaagaaactcgtcgcggcctatgaatcggccgacgtgcgcaagttcatcgaccagaagttcggcggcgcgatcgtgccggcgttctgaacgcccacgcgtgccttcgcccggccggatggatcaccgggcattccggaaagcaaatcgcccgcgcaagcgggcgatttcgttggtgcgcgcgggtgagcgccgggagatgcccgatacgcgccgtgacccggcgcgcgagccggccgctcaggccgacagcagcgaacccgtgcggatcgcggtcgcgcccgcgatgcgcgcgacttccatgccggccgtcgcgaagcgcacgatctggcgcgcgtacagcacgcccgacacgctgctcttcagcgtgacgacgcgatcggtcagcggatcgacgatgtcggccacggcctggccggcctcgatcatcacgccgaccggcgtgcggaacacgatcacgcccgacacgggcgcgacgagcggatcggtgcccgcgagcggcgtggccggatgcgcgagcggcggcagcggcgccggcgtgccttcgacgacaccgcgctcggtcaggtattcgacgatcgcctgcgcgtccttttcggcgaactcgtacgacacgtcgcgttcgctgcgcagttcgaccgtgacggaaatcgcgccgttcgggatcgggaagcggtcgccgaaacggctgcgcagatccgaccagcaaaagctgtggatttcatcgaacggattgccgaccgaattcagcgcgagcagcgacgcctgcgcgtcgagatagcgcgccagcggctcgacgtcggtccacagatcgggattcgtgtagaggtgcatcaccgcatcgctgtcgcagtgcaggtcgagcacgatatcggcgtcgaacgacagcttctgcagcgcgaggcgctgcgaatcgagctcggtgcgcggcttctgctcgtcgagcgcttcgcgcatcgcggcgcgcacggcgacgaggttgtgctgcgcatcgtgcgtgaggcggtgttcgacgcgcggcagcacgagcgccgcgagatcgtagaaattgcggttgaagttctgcatcgagccgagctcgaagcggccgaggtgatcgccgaacacgtgctgcgacaggccgatcgggttcggtacgggcacgatgacgacttcgccgcgcagcttgccggccgtttcaagcgcggcgatcttgcggcgcagcagcgtggcgaccagcatgccgggcagttcgtccgcgtgcagcgacgactggatgtagaccttcttgccgccgcgcgggccgtagtgaaagctcgtgatctggcgttcggtaccgacggcggggaaatcagcggatgggtctgcgtttgcatgatggggagtgcggcgcagccgcgaatgatccggtgtgcgtggaagatcgattgtacgttgccttcctcgcccccatcaaaccggcgccagaacgcgccgattttcgttgcgaatcatcaggttggtgcggaaaaataacgccgcggccgccgtgcacgaaaaacgggctccttgcggagcccgttcgtgccgaagcgaagcgtgcgcttgcgtggcggattacttgccgtagacgtcgaaatcgaagtacttcttcgcgatcttcgcgtacgtgccgtccttgcgcatgccggcgatcgcgctgtcgatcttcgccttcaggtcggtgtcttccttgcgcaggccgatgccggcgccttcgccgagcgtcttcggatcgtcgagatccttgccggcgaagtcgtagttcgcgccgcgcggggtcttcaggaagccgatttcggcctgcaccgcgtcctgcagcgcgccgtccagacggccggagatcaggtcggcgtagacctggtcctggttctggtaaggcacgacgttcacgcccttcggggcccagtacgtcttcgcgtaggtttcctggatcgtgccctgctcgacgccgaccgacttgcccttcagcgattcggcagtcggcatcaggccggcacccttcttcgtgacgaggcgcgtcggcgtgttgaacagcttcgccgagaaggcgatctgttcctgacgcgccggcgtcatcgacatcgacgacagcacgccgtcgaacttgcgggccttcagtgccgggatcatcccgtcgaagtcgttttcgatccacacgcacttcgcgttcatgcggcggcagatttcgttgccgagatcgacgtcgaaacccacaaccttgccgtcagcgcctttcgattcgaaaggcgggtagcttgcgtcgacgccgaaccgcacggtcgaccagtccttcgcatacgcgctgccggccgatacggcgagcagggcaacggtcacagccgcaagaatctttttcaccaggtgactcctcgttttgttcgatgggtgcgcggttgtgccgcgccgtaagccttcggcccgccgcggcttcgcgtcaggctgtccgtttcgcccacccgatgcgggcgcgcgacgtgcgcaagattatcaagacaaaataccggcagggcgcctaggacaagccccgataccgggcccggcggcggcgcgttgcgtgcgccgccgtttcagacacaggaacgattcagccgagcgtttcgttgaccgcacgctgcaggcacgtgacgaattgcgtgacggcgggcgtgggcagcaggtcgcgccgcgcgatgatcgacaggtcgaagcgcggcatgcgctcgtcgagttcggccgtgcggatgccgagcggcgcgaccgtcgcggcgagcgggcgcgtgaagcagccgatcacgtccgagcgcgcgacgagcccgagcgtcaccgcgaacgacatcggcgagcgcaagagccgcttcggcagcggcagcccgtgcgcctggaacatcccgaccatcacgctgtgcggaaactgctcggcgccgacggtgacgatccactcggcatcgagcaattcctctaaccggcgcgcgtgcgcgagcgggtggccttcgcgcatcacgacggtgaattcggtcgacagcagcggcaactgcgtgaaatcgcggtcgagcgcgggcacgtggtgcatcgcagcgatgtcgagcgtgccgttgcgcaactgcgcgagcgcgtcgggcaccgtcacttcctcgagatgcaggctcacgtccggcatcgaccggcggaatgccgtcaccgcgcgcggcagcgccgtcagcgcgatcgacggcatcgtgccgaccgcgacgcggccggacatctcgcccttcacctgttcgacggcctcgaccgtgcggcggatatcgccgagcagttgctcggcgcgcggcagcagcgcatggccgcacgcggtcagctcgacgccgcggacgctgcgcgcgagcagctccgcgttgagcgccgtttcgagctcgcggatcgtatgcgtgatcgcgggctgcgtgacgccgagttcgcgcgccgcggcgcgcaggctcttgtgatgtgcggcggagacgaacgcctggagctgcgcgatgttcaggggattgcggatgcgggtcatcgatcgggtccggttggcgcgaaagggggcggcggctggatgcttcaggtagtgatcctgacgaacgtcacgcgccggcgcgtgcgcggaacgtctggcgataacgctgcggcgacgtgccgacgatgcgcacgaaccgctcgcgaaacgcggtgaccgaaccgaatccggcttccgtcgcgacatgctcgatcgacagcgccgtcacctccagcaactgctgcgcgtgcctgacgcgtgcggtctgcaaccattgccgcggcgacgtgccggtctgttcctggaagcgccgcgtcagcgtgcgcacgctcgtcgatgccttgcgggccatctcgtcgagcgtgagcggcttgcgcaggttcgcctggagccagtccatcaggtcgtgcagcccgtcgccgccggccggccattccggcgcgatgaactgcgcctgcccgccttcgcgcacgcgcggcgccaccgcgctgcgtgcggcgtcgacggcaaccgccgcgccgtagtcggcctggatcatgtgcaggcacaggtcgaggccggccgccgcgccggccgacgtcaggatgcgcccgttgtcgacgaacagcacgttcggatcgacgtcgacgtccggatagcggcgtgcgagttcggtggccgcgagccagtgcgtcgtcgcgcgcaggccgtcgagcaacccggcttccgcgagcacgaacgcgccgctgcagatcgacgcgatccggcaaccgcgcgcggcagccgcgcgcaacgccgcgagcacgcggggcgacgtgggcgcgagcggctcggacgtgccggggaccatgatcgtatcggcgccggccagcgcgtccagccgaaacggcgggcgcagctcgaacaggtcgccggtgacgcgcggctgctcgctgcacacccgcacgtggtaggccggcgcgacgtcgggcgaccgcacgcgcgcgaacgtgtcgcaggcgacgcccaggtcgaacgggacgacatcgggcaaggcaagaacggcgaccgtgtgcatggcgttcgcggccgtggccggaatccgttgaaagatgtcattctagccaatggctcgaacccgcaccacgcgcgacaatcgcggtggatcaacctggagctccgccgatgaaacaagacgatcgcaatgcgttgcggaacctgcagtacctgtcgttgctggaggcgaccacgctcgtcgtgctggtgtgcgtcgccgtgccgctcaagcatctggccggttatccggtcgcggtatcgatcatggggccggtccacggcatcgcgttcgcgatgtacgtgtgggcggtcgtcggcaccgcatcgagcgggctgtggagcaggggcgacgtcgcgcggctcgtgctgtcggccgtcgtgccgttcgcggggctggcgagtgcgggatggatcgcgcgccggaggcacgcgcgatgatctacctgatgatgaagaccgtgcacgtggcggccgtcgtcacgttcgtcggcgggctgctgatgctgtccgtcggtgtccggatcgcgaacctcgccgtgcatcgcgcggtgcggcgctgggatcgcacggtgacggcgcctgcactcgcgatcgtctggatcacggggatcgcgatcgcgctgagcggtcactggttcggcgcggcgtggctgtcggtgaagcttgcgatcgtcgtcgcgctgtcggcgctgcacggcatgctggccggcacgctgcggcgcatggagcgcgacgatctcgtcgtcgtgccgacaccgtggctcgggcgggcggcgggcgcggtcgtggccgcgacggcgatcgtcgtcgggctggtcgtgatcaagccgttctgacgagtgccgtttcgaccgccgccagcgtacggcgccggatccagccgcttcccagccggatcgcgagccagtacggcgtgagcagccagcgcgtgcgctcgctcgggcagtggatgaacgtttccgtgcgcagcatgtgcgcgcccgatgcgagcccgacgacctcgaagcggagcaccagcttcgcatcgcgcgggtcgtcgtgccgcacgaaggccgttgcgtcggcgatcgttcgaacgtcgggcgtgggacgccagaagcggccgacgaggccgagcgacagcgacgtgtcgtcgcggtggagcagcgtgaacgagtcgaagccgaagcgcgcgtgttcggggcgggccggcccgttgcggagcgcgccggcgacggcggccgggaattcgcgcaccatgagcagtgcgtcgatgacgggatcggcgcgcatgtcgagcgacgcgacggcgtcgatgatgcgcgcgggcggcgcgtcgatcggctgcgattcatgcacttcgtggaacccgaacgacgggatgaacggcggcttgcgcgccgaggtccgggtgctcgattcggagacgatgccgagcgcgttcatcgcggctcctgaagggggcaaagcgcgatcgtagcaccgggcgcgaatttgcgtcgcgccgtttccgcgacgcgcatcatactgcgccgcacgcacaaaaaagcctggaaacttgcgttcccaggcctggagaccatcaacgacgatggtggaggagacgatgtcgtcccgatgcgcgccgcccttctgcaggcaacgtcgcgcaggtttcgcggtcagatcgcccagccgccgagatagaacgtgacgagcacggccgcgatgagcacggtgccgacgttcagcttgcggaattcgccgctggcgatgcggccgatcacgagcgtcgagaagccgagcatgatgcccgtcacgatgttcgcggtcagcacgatgaacaccgcgcacacgaggcccgacatcgcgtcgaccatgtcgtccatgtgcagcttgctcacgctgccgagcatcagcaggccgacgtacatcagcgcgggtgcggtggcgtacgacggcacgaggcccgcgagcggcgagaagaacatcacgacgaggaacagcaggccgaccacggcggccgcgaggcccgtcttcgcgccggcggccacgccgacgctcgactcgatgtaggccgccgccggcgcgccgccgaggaaaccggagaagatcgagctgatcgaatcggcggtcagcgcgcggccgccgttgatgatgcggccgttctcgtcgagctggccggcctggcccgcgaccgcgcggatcgtgccggtcgcgtcgaacacggcagtcatcaccagcgccagcacgctcggcagcacggccatcgacagcgcgcccttgatgtccatcgcgccgatcagcgatgcatggcccggtgcgctcagcgacggcggtgcgaagacgccgtggtacttcacggcgggatcgaagatcagcccgaagatcgagatcgcgatcacgacgagcaggatgccgcccggcacgcgacgtttctcgaggccgaagatcgcggcgaggccgacgacggacatgatcaccgggagggcggtgatctggccgagcgagaccggcaggccggcgcccgggttcttgatcacgaggccgacgtcgttcgacgcgatcagcagcaggaacaggccgatgccgatcccggtgccgtgcgcgacgcccgcgggcaggttgcgcaggatccacgagcgcacgccggtcaccgagatgccggtgaacacgaggcccatcaggaacacggcgccgagcgcgaccgtcggatgcagccccttgccgagcacgaggccgaacgcggtgaacgcggtcagcgagatcgcgcagccgatcgcgatcggcagcttcgcccacaggcccatcagcagcgagccgaacgcggtcgtgaggcagaccgcgacgaacaccgcgctcgtgtcgaagccggccttgccgaacatgccgggcacgacgaacacggaatagaccatcgcgaggaaggtggtgacgccggcgacgatctcggtgcgttgcgtgctgccgcgcgacgaaatgccgaagtaccggtcgatgactccctgggtgccaaagtcagattctgccgcgccgacgtcgaccgtcggctgcaccggggtatcactcatgagcttgctcctttatcagcatgctgaaacggcccgtagcgaaccgtcgtcagggtgtctcgtatctggttgggatttgtcggcaacgtcgtggggacgaatgacgcgtgatgcgtgtcgttacgtgcgaatcgaaacgatcgcgagggtgtcgcgtcggacgacgcgtgctgtggtcgaccccgtcacgtgtgctttgccgtagcgaaggttaggcgagcggcccatcacgtcccatcggggaagtgcatgcagcgcatgtcgcagcgcttatatcggcgtgcaaccgggctccgtcgcgacgacacgcgtgtatacgcctagttcgaatccgttaaggcgactatttgaatgcagggtcgacgggcagggcgggagcgggtgaggcattgaatcttacgaatatctttcatcgaggcggtgcacgcgcatgaaaacggcggcgcgagacgcgatgcggtgcgcggccgtgtacaagcggcacccggatgataccggtgccgcacgcggcttgcgctcgcgcgttccggcctttgtcgcttcggtcacgccgatcgcgtcagtcgcttgcgagatgcgagaggtacgcgcagaacatgtcggccatcgcggtcgaataggcgtcgatttccgccggtgtgcgcgcggtttcggagaatgccttgccgcccgacgtgagcgtcgtcatgatcagctcgcaggcgagcgcatgcgtggtgtcgggcacgccgggcaacgcttcgcgcatgaacgcgttgaagacccggttgccttcggctttcacttcctgcgcttcgggggcgtcgcgatagagcggtgcggcgtcgtcgagcgcgatgcgcatgctcgcctcgtcgcattccgactggatgaacgcatggacggccttgcgcagtcgctcgggcggcgtcttctgcgtgtcctgcagtatctggcacagcatgtcggacgtctgccgccattcgtcgtgctgcagccggaacagcaccgacgccttgttcgggaagtactgatacagcgagccgacgctcacgccggcgcgctcggcgacgcgcgccatcgtgaagcgctgcgcgccttcggtcgccaaaacctgaacagcagcctggaggacgtcttcgacgagacgggtcgagcgcgcctgccgaggcagcttgcgcgtggcaatcggggcgtttcggcggtcggtcatgggcggtttgccaatgcgaatagtaaaacctgaatagttcgtcatattctagtcgggcgcactgacgcactcaacctgacaccggagatccgcatgaccaccctgattcacgacccgctggcgtcgctgctcgcgcgcctgttcgacgaagccgaggcggcgtcgcccgcgacgagctcggccttcgccgacctgtcgcgcgacgagcaggcgcggctgatgcgcagcaagacggactacaccgatctgtatgcgcgcctgaaggactatccgcttcccgtgtcgcgcgagacgggcacgctgctgtacatgctcgcgcgcagccgcggcgcgcgggcgatcgtcgaattcggcacgtcgttcggcatttcgacgctgcatctcgcggccgcgctgcgtgacaacggcggtggccggctgatcacgagcgagttcgaaccgtcgaaggtcgcgcgcgcgagggcgaacctgacggcggccgggctcgccgatctcgtggagattcgcgagggcgatgcgctgcgcacgctggccgccgatcttcctgattcggtcgacctgttgctgctcgacggcgcgaaggggctgtatccggagatcctggcgctggtcgaacctcgcctcggggcgggggctttcgtcgtggccgacaacgcggaatacagccccgactacctcgcgtacgtgcgcgcgccggaaaacggctatctgtcggtgccgttcggcggcgatgtcgagttgtcgatgcggatacgttgagcgggcgtaacgcgggtgtcgacgctttcacgcttccgcgcatgaaagataggaaaactgaatgaatggcggcgtggcagcgtggcggcaggaagcggaagaggcccggtgccggcggcgccgggcgttacctcacttcacttcaggaacacatagcgtgcgaagtaaggaaagcgtccgaccgcatgctcggtcgtgcacgtcgccgccggcggcgtgccgcccgccgtgtcgagccgctgcacgaagcgtacgccggcaagcgtgccggtggcggccggcgtggccgcgagcagcagttgaggaacgctgcccgggcgtgcactcggcgcttcttcgagcttcttgccggtgatgcggctgccgtcgagtgcctcccacgacgggcccgcgccgtgccggacgacgagggtgccgccggcatcgaacagcagcgcttcggggtactggaaggcccacgcgagccggtgcccggcatcgtattcgcaggcatagacctgcatgccgctcgcggtggtcgacagcaccggcgtggccggctcgggcggcgcgaggccggcggcctcgtcggcatgcgcgggcgcggtgaacgccgcgcaggaaagaccggccgcaagggccagcagcatgtcgcgtgtcggggaacggctgggcatggcggagcgtcctctcaggtcgggtgacggtcgtgtgaagtcgatctcgtcaacactagacgccgatggcgcgggccgcaaccggaaatgacaatcgcggcgatagcggccgcgattgtccgggaggcggatgcgcgatcagcggatcgcaaccgggttgatgttgacctgcgtggagccgacgtacagcggctggccgagcacgaacaggaattcccacgccttgtcgcgcaccagcgcgcggctgtcgatcagctccaggttgtagatgccgcgcttcgcgagcatgtactggttgatcgggaattcatcctgcgtgtgcggattcctgtcgatcgtcacgccgcggcttgcgcgagcgtcgggtaatcggtcaggccccgggcaccgccgccgaacagcgtgttgcggtcgtgcggcgcgagcgcggcgccggtgcgcaggcgctcgggcaggtcggggttcgcgacgaacgggcggccgaacgcgacgaggtcggcccagccggcggcgatcgcttcgcgtgcgcgctcggcggtgtacgcgccggcgtagatcagcacgcccgggtacgcggcgcgcagctgcttgaatgcgaccggcatcagcggcgcgtcgtcccagtcggcttccgcaatgtgcaggtagccgacgccgagctcgccgagcagcttcgcggcggcgaggtaggtcgtttccggatcgtcgtcgacgcagccgttcagcgtggtcagcggcgcgaggcggatgccgacgcgcgatgcgtcgccggtgccttcgatcagcgcctgcgtgacttcacgcaggaagcgcagccggttctccagcgagccgccgtattggtcggtacgcgtgttcgcgttcgaatcgatgaactggttgacgaggtagccattcgcgccgtgcagctcgacgccgtcgaagccggcttcgatcgcgtggcgcgcggcggcgcggtactggtcgacgatctcgcggatttcgtcgacggacagcgcgcgcggctcggatgcctgcacgaagcccggcgtgctgccgtcttcaccggcgatgaacacgttcacgcccttcgcctggagcggcgacgacgatacgggttgcgcgccgccgagcaggctcgtgtggctcaggcggccgacgtgccacagctgcgcgaagatgcggccgtgcgcggcatgcacggcgtccgtcaccttgcgccagccggcgacctgcgacggcgtgtggatgccgggcgtccatgcgtagcccttgccgagcggcgcgatgtaggtgccttcgctgacgatcaggcccgcactcgcgcgctgcgcgtaatacgcggccatcagttcgttggcttcgtcgccgggctggctggcgcgcgaacgcgtcatcggcggcatcacgatgcggttcggcagcgtcagcgcgccgaattgcagcggttggaaaagcgggtcctgggtcatgatggagtcctgtcggggccgcggccggctggccgcggacgattcgattgagagagcggtgcgcttagtcccacttcggcgcgaggccggccgggtcgacttcgcggccgttgcgctccagcgcggcgatctgcgccatgtcttcgtcggtcaggcgcagcgtctgcgcgagcaggttgctcgcgaggttctcgcgcttcgtcgacgacggaatcaccgagtagccgagctgcagcgcccacgcgagcgcgacctgtgccggcgtcgcgtcgtgacgctgtgcgatcgcgccgatcaccgggtcgccgagcaccttgccgtacgcgagcgtcatgtacgacgtcacgtggatgccttcggcgttcaggaactcgacgagcttgcggttctgcaggtacgggctcagttcgatctggttcgtcgcgatcgcatccttgccgacggccgcgatcgcttccttcgtcagttcgatgttgaagttcgagatgccgatctggcgcgtgaggcccttcgccttcgcgtcggccagcgcggtcatgaacgcctcgatcgacacgccgttgcccggggccggccagtggatcagcgtcaggtcgacatagtcggtgcgcagcttgcgcaggctttcctcgaggctcgcgaccagcttttccggtgcgtagttgtcgacccagatcttcgtcgtgaggaacaggtcttcgcggcgcacgcccgatgcggcgatcgcttcgccgacttcggcttcgttgccgtagatctgcgcggtgtcgatcgcgcgatacccgacttcgaggccgttgcgcaccgagtcgatgaccacctggccttgcaggcggaacgtaccgaggccgaatgcgggaatgttgctcatcaagtgctcctgaaaggggtggaacggttgcggtatggaagtcattctggcgcttgatactgatgagataaacgcctttagaggtcaaaaatatttgatttgaattcaaatatcggtcgtgcggcgggctcgctcgaggccgttgccggccttatgcggcgcgcgtctgcgcgtttgccttcgtcttcgcgtggaatgccggcagcacgtccgacgcgatctcggccatcgtctcgtcgagcgggcggcggttgcggcggaaatgcaggccgatgtgccgtacgcccgcgtcgcgcatcgccgcgagttcttccgtcagcgcgatgcgtccggcgcgggcgccgaagcggtggcgctgcagcggctcgtgcggatcttccgcgaggtcgaggtggatgaagctcacgtacggcttgtcgccggccaccgcgcgccagttcgcggcgcgctgcgcgtggtcggccggcgtgcccggatacgcgaggcagccgtccatgtgttcgccgatccacgcgggcgtctgctgggcgagacccgcgacgagcagcggcaccggcgagcgcgcggccggcagcacctcgaggcccggcggcaggtgcccgcgcgcgccgtcgcgcagcagcgcgacctggtcgcggaaattcgcgccgcgcgacgcgaagtcgcggccgaacagcggatattcgaccggccggtcgccgctcgcgacgcccagcatcaggcggccgccgctcagttcctggatcgtcgcggccgatttcagcgtcagcagcggctcgcgcagcggcagcacgacggccgccgtgccgagcaggatgtcgttcgtgatgccggcaaggtagccgagatacgagaacgtttcgaacacctgcgcggcgtcgccgaacgacgggtcgtacaccggcacgtcgcgcacccagagcgcgcggaagccgagcgtgtcggccagctgcgcaagctccgcgtggatcgccaggtcgggcacgccggggcggcggccctgttgctggcgcttcgcgtcgccggccggcgaccagtcgttgtcgagcggcagttcgatgccgacgctgaagccgccgtcggcgagtttctcgagtgaagtggacatggtcgggctccgttcagaccgcgcgcaggctgccttcgaggcggtagaaatcgagcgacgccgcggtgaagaacgagcgcgacgtgccggcggcgaaatcgtcgacatgcacgaccgtcgcgcggtcggcttcctgccacgagatcgcgtaggtgtcgccggcgacgtgctgccacgtgtattcgacttcacccttcgcgcccgcgtacgggccttcggtgatctcgtagcgcatgtggaggccgtcctcgccgtacgcgttgagcgcggtgagaccgtcgtaacggacttcgaaagtcttgccggcgaacggcggacgttgggtcgatgcgttcatgctggttggctcctgcaaaaagtgacgttcaatgagcgagttcgacgggttcggccgtgcgttccggcagcccgtggcggcggtcgagacggccgctcagcgcggtgagcgcgaacgcgccgagcgtgacgacggcggcgatccacggcgtgtggccgaggccgacgttcgcgacgatcaggccgccgagcgacgagccgccggccacgccgaggttgaaggcggcgatgttgaaacccgatgcgacgtcggtggcgtccggcgcgaagtggcgcgcctgcttgacgacgtacacctgcagccccggcacgttgccgaacgcgaccgcgccccatgcgagcatcgtcagcaccgcgagccatttcacgtggatcgtgaaggtcagcgcgagcagcacgatcgcgagcagcaggaagatccgcttgagcgccttcacggggccgacggcatccgcgagcttgccgccccacacgttgccgaacgcgaccgacacgccgtagccgacgagcacgaggctgacctgcgacggcgtgaagccggcgatctgttcgagcagcggcgccatgtacgtgaacgcgatcagcgagccgccgtagccgacggccgtcatcgcatagacgagcagcaggcgcggctgggccagcacgcgcagctggcgggcgagcggcgccggcggcgtctgcggcaggccgcgcggcacgaacgccaccgcgccgaggaacgcgacgaggccgaacagcgcgacgatcaggaacgtcgcgcgccagccgaagtgctggccgatgaaggtgccgagcggaatcccggcgacgaatgcgacggtcattccgctgaacatcgtcgcgatcgcgctggcggccttgtctttcggcacgagcgtggtcgcgatgatcgagccgaccgagaagaacacgccgtgcgcgaggccggtgagcacgcgcgcgacgatcagcgattcgtagcccggcgcctgccaggcgacgaggttgccgacggtgaagagcgccatcagcccggcgagcagcgtcttgcgcggcacgcggccggtgagcgcggtgagcagcggcgcgccgatggcgacgctcagcgcatagaggctgacgagcaggccggccgacggcaggctgacgccgagatcggcgccgatcgtcgggatcagcccgacgatcacgaattcggtcgtgccgatggcaaaggcgctgatggtcagcgcaagcagggcgagtggcatgatgggatccaggttccagtaaggatggatcgcagtgtgccgactttactttgcggaaaaactggtctataaaccaaattgttttgatttcagatcaacaatgaagatcacgctcgacgaactccaggcctttgccgccgtggtcgacaccggttcgatcaccgcggcggcccagcagctcgacctcaccgtgtcggccacgagccgcacgctcgcgcggctcgaggagaagctgaagaccacgctgctgcgccggaccacgcgccggctcgaactgaccgaggaagggcgcgcgttcctgcaggacgcgcgcgcgatcatcgaatcggtcgagacggcggaagagcagatgctcgcgcggcgcgagatgccgtcggggcggctgcgcgtcgacgcggcgacgccgttcatgctgcacgtgatcgtgccgctcgtgcgcggctatcgcgaacgcttcccgaaagtcgagctggaactgaacagcaacgagggcatcatcgacctgctggagcggcgcaccgacgtcgcgatccggatcgggcggctgaaggattcgacgctgcacagccggcgcatcggcaacagccggctgcgcatcttcgcgagccccgcgtatctcgaagcgcacggccagccgcgcaaggtcgaggatctcggcaagcacacgctgctcggcttcacgcagcccgaatcgctgaacgtgtggccgatcctcggcgcggacggcgaagcgtgccgcatcgagccggacatctgttcgtcgagcggcgagacgttgcggcagctcgcgctggagggcgcgggtgtcgtctgcctgtcggatttcatgaccgcgcaggatcgcgaggccgggcggctcgtgcaggtgctcgcgcgccagacgctcgaggtcgaacagccgatcaacgcggtgtattaccggaataccgcgatttcgtcgcggatcgcgtcgttcgtcgattacatgatcgaggtgctgggcggcgggagcggcggcagcgatgcgccggcgcggcgcaaggcggcgtggatggggacggtgtagccggggcggctgcgtcgttgccgccgggcgccgttcccgagcaggacagctcggcggacttcctccggccgaagcgaacggcgcagaggcgggcggtgcgcggcgggcgcgccgatgtgatccggcatgccgacggcgcgtgcgccgccgacatgccgtcgcgtgctgcgcgtcctacgcttcctcggaccacgacatcccgtcgcgcgcgagcagcgccgacgaagccgcgggcccgaacgtgccggccgtgtacaggcgcggccggtcgccgagctgcttccagccgtcgaggatcggctcgacccacgaccaggcggcttcgagctcgtcgcgccgcatgaagtgcgtgaggcggccgcggatcacgtcgatcagcagccgttcgtatgcttccgcgcgccgctccggaatcgcctgctgcaggtcgaggttcaggctcacgggcaccatgttcatcccgctgcccggttccttcgcgagcatctgcagctggatcgactcttccggctgaagctggatcacgaggcggttgctgtagtggcgcgggccggtcgggatgatcgagaacggcatgtccgcgaactcgatcacgatttccgactggcggcgctgcagccgcttgccggtgcgcaggaagaacggcacgttcgcccagcgccagttgttgatgtgtgcgcgcagcgcgacgaaggtttccgcgcggctgtcggccggcacgttgtcttcctcgaggtagcccttcaccggctggccgtcgaccgcgccggccgtgtattggccgcgcaccgtgtcgcgcgcgacgtcggagagcgtcatcggccgcagcgagcgcagcaccttcagcttctcgtcgcgcaccgcgtccgggtcgagcgacacgggcggctccatcgcgacgatgcacagcagctgcagcaggtggttctgcaccatgtcgcgcagcgcgccggtatggtcgtagaagcccgcacggctgccgacacccaccgtctccgccaccgtgatctgcacgctgcggatgctcggcgcctgccacagcggcccgaagatcgggttgccgaagcgcagcaccatcaggttctgcacggtttccttgccgagatagtggtcgatccggtagatctgcgattcctcgaaatgcttgccgaccgcgttgttgatcgcctttgcggacgcgaggtcgtgaccgagcggtttttcgaggacgacgcgcgagtgcctgtcgacgaggtgcgcggccgacaggttgtcgcagatcgtcgtgaacagctccggcgacgtcgacaggtagaacacgcggatcgcgtcgccgcgcgccgcttccgcgagccgcaggtagtcgtccggcgcgttcacgtcgatcagcacgtacttgaacaggtcgaggaaacggctccaggcggcgggatcgaacgccttttcgtcgatgaacgggcgcgactgctcgtccatgaacttgcgatagccgtcgatgccccagtcgcggcggccgaccgcgatgatgcgcgtctcgggcggcaggttgcagtgcaggtgcgccatgtacagcgcgggcaacagcttgcgggcggccaggtcgccgccgccgccgaagatgatcatgtcaacgggccggtcggccgcggtctgggtaggctgattcgtcatgggaggttcgcgtctgaaacggtgagcgtggaacgaacgtcgaaggcgccgggcgccggtacggcaaaaaccctaatagtgcacgcatttgatggatcgcgtgtgtgtccgtttcctgtcgcgcagctggtggatgggtcgcaggcgggttgcaggcggtgcgggcgttgaaggagccgggccgctgccggagcgggcgagcggcatggacggtcgtcgggcggcggctcgccggcaggatgtggcgccgccggccggcgagccgcgtcgcctcactcgatcggtacggtgcccggcatacgcatccggtacagcgacacggcctggatcgcgagcgtacagacgatcgcgagaccatcggccggaatcgggtcatgccgcgtgagcgtcaggctctgcacatgaaagaacgctgcgaagctcggcagcccggtggccgtcccgcccgcgtgagcgcacgactgcccgccgagcgctcagcgccccagcgcgtaaaactccgcgttcggccgcatgttcgtcacgttcgcgatgcgattggacatgccgaagaaagccgagatcgccgcgatgtcccagatgtcttcttcgacgaagccctgcgacttgagcgtgtcgaaatccgcttcgccgacctggtgcgcggcctgcgacaccttcatcgcgaagtcgagcatcgccttctgccgggcggtgatgtcggccttgcgatagttggtggcgacctggtcggcaatcagcggatccttcgcgcgaatgcgcaggatcgcaccgtgcgcgaccacgcagtactggcactggttcacgctgctggtggccacgacgatcatttcccgttcggccttgctcaggttgcccggcttgtccatcagcgcgtcgtggtaagccatgaacgcgcgaaactcgtccgggcgatgcgcgagggtcaggaagacgttcgggatgaagcccgacttctcctggacggccgcgatgcgttcgcgaatgtcctcgggcaggtcttcgagcgcgggcacgggaaagcggctgatgggggcggtgcttgcggcggtcatgaggtctcctggataagacggcgcggccgcgctcgatgcgcgggcggccgtccgaaaatgaagcgccggtggtcggcggcgacgttacgcgttgacgtcgacgacgatacggccgcgaaccttgccggcgatcaactcccggcaagcgggatgacgtcgcccaggccgacctggtggctgatcgcgcccagcttcccgacgtcgagatcggacgcgagccggcgccacgcttccaggcggtcggcgcgcgggcacatgacgctgtcgatcccgacaagcgtgacgccgcgcaggatgaacggcatgacggtcgcggggaaatccatgccggcggccaggccgcaggccgtcacgacgccgcggtaccgcgtggtcgcgcacacgttggcgagcacatggctgcccgccacgtcgaccgcgccggcccatcgttccttgcccagcggcttgccgggctcgctgaattgcgcccgctccaggatctccgccgcgccgagctgccgcaggtagtcggcatcggcagggcggccggtgacggcgacgacgcggtatcccagccgcgcgaggagggccgtggcgacgctgcctaccccgcctgccgcgccggtcaccacgatctcgccgtcgtccgggcgcacgccatgccgctccagtgccatcacgcacagcatcgcggtgtagcccgccgtgccgatggccatcgcctgttgcggcgaaaaggcggacggcagcggcaccagccagtcgccatcgacgcgggccttctgcgccaggccgccccagtgcgtttcgccgacgccccagccgttgagcacgacctggtcgccggggcgatagttggggtgcgtgctgtcctcgacttccccgaccagatcgatgccgggcaccatcgggaacttgcggaccaccgggctcttgccggtgatcgccagcccgtccttgtagttcagcgtcgaatagcccacgcgtaccgtcacgttgccggccggcagctgcgcgtcgtccagcgtctcgagccgcgcttgctggccggtttcatgcctgtcgatcacgatgccttgaaacatgtgtcctcctttctagaccgatcgtctagttaatggcaaaaattcagcggcggggcagtccgttgaagaagaactgcgcgaacagggccagcggcgtatcgctgcgctccagcttcgcgcgcagcacggcgccttcccagccgatccagaagaatgcggcgagttcggcagggtcggccgagccggccagttcgccggcttgctgcgcggcggccaggcaatcggcgaggcggcgttgccagtcctcgaaggtggtgcgcaggcgtgcgcggaagctttcgggcagcgcgcccatttcctgcccgaggttgccgatcaggcagccccggctgtattcgtagcgggccatgccgtcccgggcatcgtcgacgaacgcgcgcacgcgctgcaacggcgagcgcgccgcgtcgctgaaatggcggtccagcttgcgcgcgaagaagtcggcataacggtcgatcagttcgaggccgaacgcttccttgctgtcgaagtagtgatagaaggagcccttgggcaccccggcgcgcccgaggatctcgtcgagcccggtggccgaaaaccccttctcggtgagcacttccagcccggtgcgcaacagcatgtcccgcgtggcgacgaggtcttcatgctgcttcggtggcctgccgcgacggcgaggcggatcagttcgaacgtccatgcgcgaataatagaccgtttgtctcaaaaatcaacgggcgcgtgtcgagcgcatccgatgaggcacggacggcgagcgacgcccgtattaaccctgattaacaaaccttatcgcggtgaaaaattccgcatcttattgaaccgatatcggctcgatatagtggctcgctttcccgcacgcacctgttgcgtgtgcagacaaacagcaggagccccttgatgaccaccgatacccgattcaccgaaatcgaggatctgatgcccgccgccggcgggttgcgcgagatccgtcaccacatccaccaccatcccgagcttgcatacgaagagcacgacacggccgcgctcgtcgccgagaagctcgatcagtggggctggcaggtgacgcgcggggtcggcaagacgggcgtggtcggcacgctgcgcgtgggcgacggcacgcgcagcatcggcattcgcgccgacatggacgcgttgccgatcgtcgaggcgacggggctgccctatgcgagcggcacgcacggcaagatgcacgcctgcggccacgacggccacacgacgatgctgctcggcgccgcgcagcagctcgcgaagacacgcaacttctccggcaccgtgcacctgtatttccagccggcggaagagcacggcgtcgacagcggcgcgaagaagatgatcgacgacggcctgttcgaacgcttcccgtgcgacgccgtgttcggcatgcacaaccatccgggcgcggcgccgggcgtgttcctcacgcggcgcggcccgttcatgtcggccggcgacaaggcgatcatcacgatcgaaggcgtcggcggccacgcggcacggccgcatctgacggtcgacccggtcgtcgtcgcggccagcatcgtgatggcgctgcagacgatcgtcgcgcgcaacgtcgaccccgcgcagccggcggtcgtcacggtcggctcgatgcacgcgggcaccgcgaacaacgtgatcccgaacggcgcgcgcctcgaactcagcgtgcgttcgttcagccccgacgtgcgcgcgctgctcaagcgccgcatcaccgagctggccgaatcgcaggccgcgagctacggcgcgacggccagcgtcgagtacatcgaaggttatccggtcgtcgtcaatacggatgccgaaacggactttgccgcgcaggtcgcgcgcgaactggtcggcgacgcgcacgtggtcgagcagaccgacctgctgatgggcagcgaggatttcgcgttcatgctgcaacagcggccgggctcgttcgtgcggctcggcaacggcgaaggcgaggacggctgcatggtgcacaacccgaaatacgacttcaacgatcgcaacctgccgatcggtgcggcgttctggacgcgtctcgtggagcgttacctcgggcggtgattcaggcggcgcggcgcgcggccggcgcttccggccgcattgagaggagaggacaacgatgcagaaagaccatctcgcgctgcaccccgtgtcgacggggagcgccgaagtcggcacgccgcgcgcaccggccgtcacgcggcgcggtgcgatcgcggcggccgtgatcggcaactggctggaattcttcgatttcaccgtgtacggcttcttcgcggtgctgatcggcaagctgttcttcccgtcgagcgacccgaccacgtcgctgctgctgtcggtcgcgacgttcgccgccggcttcttcacgcggccgctcggcagcgtcgtgctcggcgtctacgcggaccgcaaggggcgcaaggccgcgctgaacctgacgatcatgctgatggcgctcggcacgggcctgatcgcgatcgcgccgacgtatgcgcaggtcggcgtggccgcgccgctgctcgtcgtgttcgcgcggctgatgcagggcttctcgcagggcggcgaattcggcgcggcgacgtcgacgctgctcgagcagggcggcacgtcgcgccgcgcgttccgcgcgagctggcagctcgcgacgcagggcggcgccgcgctgatgggctcgggtttcgcggcgctgctgtcgaacacgatgacgaaggacgcgctcgaaagctggggctggcggctgccgttcctcgtcggcgtgctgatcgcgccggtcggcatgtacctgcgccgccggctcgcggacgatgcgccgggcgacagccatcacgggatcgaacgcggcgtgctgcacgagctgttctcgaagcacacgcgcacggtgctgctgctgatgctcacggtgatgggcggcacggtgtcgacctacatcctgacgttctacatgccgacctatgcgatccacacgctcgggctaccgatgaagctgtcgatgttcgtcggcgtcgcgtcgggctgcgtgatgctggtcacgtgcccgctgttcggctggctgtcggaccggctcggcagccgccgcctgccgatcttcgtcggccgcggcgtgctggtcctgttgctgttcccggcattctggctgatgaaccatcacccgacgctgtcggtgatcctgccgctgaccgcgctgatgctgctgttctattcgctcggctcggcgtcggaaatggcgctgatgtgcgagtcgctgccgcgccacgtgcgcgcgaccggcatctcgatcgcgtatgcgctcgcggtgacgatcttcggcggcaccgcgcagctgatcgcgacctggctcgtgaagacgaccggcagcaagctcgcaccggccggctacgtggctgcgtgcgtggtgctgtcgctgatcgcggtcgcgatgctgcgcgagacggcgcgggagtcgatcgactgacgcgcggcacagcacggcgggcggcgggctgcagtacgcgcttaccgcccgcgcaccatccgcaggtacgacgcgagcatcgtcgcgagttcctgcgcggccggtgtcagcggcacggccgcgcgctgcagcaggcagatgtcctgcgattcggcctgttcgcgcacgggcaccttcgcgagcgcgccggcgaacggcccgtgccgcgtgatggcttcggtttcgagcgcgagggaatcggtctgcgtgacgatctgcagcgtctcgaacatcccttcgacggtcgcgagaatcctcggcggcggctggccatgcgcgtcgaagtacgcgagcagccggttcacgaccgggtcggcgctcaggttcggcgagcgcgtcgacacccacgcgtagccggccagttcggcgagcgattttgcgtgcatcgccggatgcccgtggcggcacacgaccaccggcgctgacgcacgcaacggcgtgaccgcgagatcggtcgtgtcggtctgcttcgcgacgagtgcgatcgcgaaatccaccgcgctttcgcgcagccagccgatcatcatccgcgacgtgccggtgcgcaggtgcacgtcgaccttgtcgaagcgcgcgcggaacgcgctcagcacgggcgcgaacgcgtcgatcagcggttcggccacgaggccgagcgtgacggtgccttcgtacgcgccgctcaactgccggatctcccgctcgacctgctcgcattcgccgaggatcgaaccggagcgcgcgagcagccgctggccgacggccgtcggcacgatcccgcgattggtgcgcgtgaacagcgtcgcgccgagcgtcgcctcgaggctctgcaactgctgtgtgacgccgctctgcgcgagatcgagcgcgcgtgcggcggcgcgcaggctgccgtgctcgacgacggcctggaagatgcggagctgggagagcgtgaacgccatgggcacgcgcggggccggtgatcggaaacaccgatcatgataaggcagtcgatggttccggcggcggcccgtgccgcctacgatcgcaggcagtccggctgatgccgtttgccttccttcctgtcctccgtcgaccatgaaacgtatcctcgtcccgctcgtttccctgtgccttggctgggctgccacgtccgcgtttgcactcgacgcgcacgtcgtgcgcctcggcatcgatccgacctatccgccgatggactcgaaggcgcccgacggcagcctgaagggcttcgacgtcgatctcggcaacgagatctgccgccgcgcgcagttgcgctgccagtgggtcgagctcgaattctccgggatgattcccgcgctgcaggcgcgcaagatcgacgcgatcctgtcgtcgatggcgatcaccgaaaagcgcgagaagcagatcctgttctcgtcgaagctgttccgcttcaagtcgcggctcgtcgcgcggcccgggagcggcctcggcagcacgaccgcgtcgctggccggcaagcgtgtcggcgtgcagtcgggcacgcagttcgaatcgtgggcgctcgcgcactgggcgaccgccggcgtgagcgtggtgccgtacaagagccaggacgacgtgttcgccgatctcgtcaacggccgcctcgacgcggcgctgctcggcaccgtggaagccgactacggcttcctgcgcacgccgaagggcaacggtttcgcgttcgtcggcgcgccgctcgacatgggcgatcgcggcgtcggcatcggcatgcggcagtcggatacggcgctcaaggcgtcgatcgacggcgcgatcgcgtcgatgctgaaggacggcacgtacgaccggatcgcgaagaagtatttcgacttcaacccgtacggcgactgagcgccgagccaccgcgccgttgtacccgcggccccgttttcatccgttcgagaccctcgatgcagattcgcaccacgccactcctgtcgccgtcgatcggcacgcagcgcacgctgacgagctttcatttcgggccggccggcaccggccgcaagatctacctgcaggccgcgctgcacgcggacgagacgcccgcgatgctcgcggcgttcgtgctgaagcagcgtctcgcgcagctcgaggccgaaggccggctcgcggccgagatcgtgctcgtgccggtcgcgaacccggtcggcctcaatcatcatctgctcgggcagttcatcggccgtttcgaccttgcgagcggccgcaacttcaatcgcggcttcctgccgctcgcggacatcgccgcgcgtgcgcgtgaccggctcggcgacgacggcgaacgcaatcgcgtgatcgtgcgcgaatgtgtcggcgcggcgctcgacgttatcgcaccgcgtacggaattcgatgcgcttcagctggcgctgctgaagctgtcgttcgacgccgacgtcgtgatcgacctgcattgttcgctcgaagcggtgatgcacgtgtacacgagcgataccgcgtggccgcaagtcgagccgcttgcgcgctatctcggcgcgcaggtgtcgctgctcgcggaggattcgggcgggcacgcgttcgacgatgcgcatcatctgctgtggtcgcagttgcggcagcacttgccggccggcacgccgatggcggccggcaccgtggccgtgacggtcgagtgccgcgggcagcgcgacgtcacgtacgaccatgcggagcgcgatgccgatgcgctcgtcgcctatctcgtgtggtgcggcgcggtacgcggcgaacgcgtgccgctgccgccgctcgccgcgccggccacgccgctcgcgggcagtgagcagttctacgcaccggtgagcgggatcctcgtgcaccgcgtggcgatcggcgcgacgatccgcgccggcgatccgctgttcgacatcgtcgatccgctgaccgatgcgatcacgacgatctcgagcgggaccgacggcgtgttctacatgcgccgcgcgatccgtttcgtcacggccggcgcgccgctcggccgcgtcacgggcgcagtgcccgtgcgcaaggggatgttgctcggcgcgtgacgagcggcgcgcgtcgcgtgcgacgaacccgacctttacgaaatcgtcgagaaatttcggtttcctcagataatcgctcgccgctcgatcccggcctgcaccggggcggccgcctggagacggccggcggacgcaggccgcatcgtcagcagggacgttcatggcccgccgcgacgcacggcagcacgcttgcctggcttgccgcgcgccgtcgtcccgccgttgtgcccgcccgcgtccgaaaacatcttcatgtcccgaaggatgccgcgcagcagcgtatcggctgccaccccgagcgtgcggccggccttgaccagcagccgcgcgttcgctgcctcgagcagcggatgggcgacgggaacggcgacgagttctcccgcctccagctcctgatacgccgcgaacgcggcgagcagcgtgacgccgtcgttgcgcctgacgaagtggcgcagcacggccagcgagttggtggtcagcgtcgggtggagctggatgttctccgcataggcgagcatctgcacggcctgcccgagaccgaacgccggcggcatcagcgcgagcggatacccggcgagttcgtgtaccgcgacgggccggccccgcacggcgagcgggtgcccgggatgcacgagcgccaccaccggctgcggcgcggtggcgacgtactcgatatccggatgcgccggggattgtaggcgaggccgatatgcgcgcggctctcggcgacttcctgcagcaatgtgctgaccggaaggatatcgacggtgacgtcgagcttcggatagcgcgcgcaaaaatcggtgagcacctcgtccatcagacagtcgatatagccttcgctggtggcgatgcggatctggccgtgttgcaggccgtgcagcgcctgcaggcggtcttcgaacagttcctgctgggagcggcagccgcgccagtattcgagcaggtgcgccgcggcttcggtcggccggacgccgcgcggctggcgctcgaacagcggcgccccgatttcttcctcgagtagccggatctgccgcgtgatgacggacggcgacgtgttgatgctgtcggccgcgccgcggatcgagccgtgcgtcaggacttcatggaaatagcgcaggcggcgctggttcagttcgcgcatggtgtcggtccgtttgctgttgaagtgttgctcgttgagcaacgataactcgcttaggttgctattgcgctgctttttcggctcctcgacgattcgaacggagtcgatcatcgatgcgggattcgaagcaatacgccctaaaggagagcgcatgtccgccattccatcccctcaagacccggtcgcgcccgacagcccggcgcatcaggccctgtatcgcaagctgaactggcgcctgctgcctttctgctgctctgctacacgttcgcctatctcgatcgcgtgaatatcgggttcgccaagctctcgatgcagagcgacctgggcatctccgatgcggtgtacgggctgggcgcgggcatcttctttctcggctacgtgctgttcgagatcccgagcaacctgctgctgccgcggatcggcgcacgcaagaccatcagccggatcatggtgctgtggggcctgacctcggcgggcatgatgttcgtccacaacgagaccaccttctacgggatgcgtttcctgctcggcgtgttcgaggccggcttcgcgccggggatgatctttacctgacctactggtatggccagcgccgcatggccggcgtgatggcggtcgtgatgctcgcgggcccgatcggcggcgccttcggctcgccgctgtcggcgtggctgatgaccgggctgtccggtgcccacggcctggccggctggcagtggatgttcatcgtcgaaggcctgccgtgcgtgctgctcggcgcgctcgcactcaaggtcctgtccgaccggccggccgacgcagcctggctgaccgacgacgagaagcggttgctcgccgccgagctgcacgcacccggcgccggtcatcactcgttcggacaggtgttgcgcgacccgcgcgtctacctgctggcgttcgcgtacttcacgatcatctgcgggatctacgcggtgagtttctggctgccgtcgatcctcaaggccgacggcgtgaccgacacgatgcagatcgggctgtactcgatgatcccgtacgtctgcgccgcgatcgcgatgatcgtcatcggccgccggtcggaccgccgcggcgaacgccgtttccacagcgccgtgccggccctgatcggcgcgatcgcgctggccgtggcgacgacggccaacggcaatctcgtcatttcactggtcggcatgacgatcgccacgtcgatgatctgggccgcgtacacggtgttctgggcgattccgtcgcaatacttgaagggcgacgcggctgcgggcggcatcgcgctgatcaatacgatcggcctgatcggcggcttcctgagcccgaccatcatcggtgcgatccactcggcgacgggcagcatggcagccggcctgctggtcatggtcgcgctgctggtcgcgggcgccgcggtgctcgtggcgaaccggctgcccgcgccgcacgacgcgttggcgacggcgtgatatcgcgggcgcgcaagcgctcgcgacctccgttgcggcgcagcacggcccgtgccttgactacctatttccggagacacgtttttgaacacgcggatcttgattgccggctttcagcatgaaaccaatacgtttgcgccgtcgaaagccgcttacgcgaacttcgagcgcggcgagggcttcccggccatggtgcggggcgacgacgtgcttgcgctgcgcgacgtcaacattcccgcgggcggattcatcgtcgcggcggagcgacgcggctggaccctgctgccggtcatctgggcgggcgcgagcccgtcggcccacgtgaccgaggatgcgttcgagcgcattgccggcgaaatcctcgcggcggttcgcagcggaggctacgacgcggtgtacctcgacctgcacggcgcgatggtcgccgagcataccgacgacggcgaaggcaccttgctggagcgcgtgcgcgccgcggtcggcccggccgtgccggtggtcgcgtcgctcgacctgcatgccaacgtcaccgcgaagatgctgcacgaggccgacgcgctggtcgccttccgcacctatccgcatgtcgacatggccgagaccggcgaacgcgcggccgtgctgctcgagcgcctgctcgcctcgcgggcggcgggtggccgcccgctgcatcgcgcggcgcggcggctgccgttcctgatcccgatcaacggcatgtgcacgctgctcgagccttcgcgcggcatgtatgcgcaactcgcggcgctggaaaccggggccgtggcgtcgctgtcgttcgcgccgggttttccggcggccgattttcccgaatgcggcccggtcatctggggttacggcgatgacgccgcgtcggccgaggccgccgtgcaggcgctctacgacaggatgctggcggacgaggccgcgtggcaggtaccgttcctgtcgcccgatgccgccgtgcgcgaagcgatgcggcttgccgacggggccggcaagccggtcgtcatcgccgatacgcaggacaaccccggcgcgggcggcgactcgaacacgacgggcatgctgcgggcgttgctgcgcaatggcgcgagagatgcggcgatcggcctgatctgggacccggcggccgccgcggcggctcatcgcgccggggtcggggcgttcgtcgagctggcgctcggcggcgtttccggcgtgcccggcgacgagccggtccacgcgcgtttcgaggtcgtgaagttgtccgacggcgtatgccggtacgacggcccgatgatgaacggcatgcgcgcggatatcggccccgtcgcctgcctgcggatcgatggtgtgctgatcgtggtgagcagcggcaaggcgcagatgctcgaccgcaatctctatcgcgtgggcggcgtcgagccggaagcgatgcgcatcctcgtcaacaaaagctcggtgcattttcgcgccgacttccagggatcgccgaggcggtgctcgttgccacggcgcccggcccgatgacggccgatccggccgagttgccgtggacccggctggccccgggcatccggacgaagccgatgggcgacgcattctccggcaacggctgacgcacggcacgccgccggcgcgccggtacgcctgcgagcgggcggctgtcctggacaatgccgtcgcgcgggccgacacagggcgccgcgcgtcgtttcacgccgtgcggcgtgcgcgtacccgcgcgcggatcggcgctcacccgcgccgcgccaccagctccgacaccgtctgcgcggcctgctgcaacggctcgagaaactccttcaccatctgctttgcggtatgccgctgcgcgttgccgctgatgttcatcgccgcgatgatctgcccgcgccggttgcgaatcggcgcggacagcgacatcaggcccacttcgagctcctggtcgaccacggcccagccctgctggcgcacctgtgcgatcgccgccttcagttcgccgaggtcggtgatcgtgcgcgccgtatgcgcgcggatgccgctttgcgcgagcgtttcgtcgagcgcggcgtcgtcgagcgcggacagcagcacgcggcccatcgacgtgcagtacgcgggcagacgactgccgatcgacaggttgatcgtcatgatcttgcgggtcggcacgcgcagcacgtagacgatctcggtgcggtcgagcacggccgccgagcagctttcgtggatctgctcggacagttgctccatcacgggatcggcgagattccagaacggcatcgacgtgaggtacgcgaagccgagctcgaggatcttcggcgtgagccggaacagccggccgtcggcctcgacgtagccgagcgtctgcagcgtgagcaggatccggcgcgcgcccgcgcgtgagcccggtggccgaggcgacctcggtgagcgtctgctccggacgggccgcgtcgaacgcgcggatcaccgcgaggccgcgtgcgaacgactgtacgtaggagtcgccgggtttcgtctgagtgtcttcggttgtcatgagcgcctggaatatcgtgcagccgagaagatagcgcacggggcccgacacgccaaccgcacggcggaccgggcgcttgacaggtcgtccccgcactccctatgatgcgttgaacgttcgatacacgatcttatgttcgtatatagaacatttaagcgcatcccggcgggcaatgcaaggggcgcgccctgttcattccccagcctgtcctgggagcggagacactgatgaccgaagcttttctgtgtgatgcgatccgtacgccgatcgggcgttacggcggtgcactgtccggcgtgcgcgccgacgatctgggcgccgtgccgctcaaggcgctcgtggagcgcaaccgcgacgtcgactggacggcgatcgacgacgtgatctacggctgcgcgaaccaggccggcgaggacaaccgcaacgtcgcgcgcatgtccgcgctgctcgctgggttgccgcagggcgtgccgggttcgacgatcaaccgcctgtgcggctccgggatggatgcggtcggcgtggccgcccgtgcgatcaagtcgggcgaggccgcactgatggtcgcgggcggcgtcgagagcatgacgcgcgcgccgttcgtgatgggcaaggccgcgagcgcattcgcgcgccaggccgacatctacgacacgacgatcggctggcgcttcgtcaatccgttgatgaaacagctgtatggcgtcgattcgatgccggagacggccgagaacgtcgcggtcgactacaacatcagccgcgccgaccaggatctgtcgcgctgcgcagccagcagaaggctgcgcgtgcgcagcaggacggcacgctcgccgaggaaatcgtgtcggtcacgattccgcagaagaagggcgatccggtggtcgtgtcgcgcgacgagcatccgcgtgagacgtcgcttgaaacgcttgcgaagctgaagggcgttgtgcgtccggacggctcggtgacggccggtaacgcgtcgggcgtcaacgacggtgccgccgcgctgctgctcgcgaacgaggaaaccgcaaagcgcttcggcctgacgccgcgcgcccgcgtgctgggcatcgcgacggccggcgtcgcgccgcgcgtgatgggcatcggccccgcgcctgccacgcagaagctgctcgcccggctcgggatgacgatcgaccagttcgacgtgatcgagctgaacgaggcgttcgcatcgcaaggtctggcggtgctgcgcatgctcggcgtcgccgacgacgatccgcgcgtgaacccgaacggcggcgcaatcgcactgggccatccgctcggcgcatcgggcgcgcggctcgtgacgaccgcgatgtaccagctgcatcgcacgaacggccgcttcgcactgtgcacgatgtgcatcggcgtcggtcagggcatcgcgatcgcgatcgaacgcgtctgacccgcgtttcatgtctcgcggcgaagcggcggccacgagccgcttcgctgctcgaccgctttgcctctcgaccgattcgccgctttggaaacgatgcgcggcacgaggatgctcgtgccgcgcatcgtcgttaaccggcctgcgacagctccctgaggcgcgcctcgagcgcgtcgatctcggtgtccgcgaacacctcgatcccgtgctcgcgcagcaacgccgccgtgacgccggcgcccgcgtgccgccggttcccgaaactcccgtcatggatgaacgtgctgccgcacgacggactgccgtcggccaggatagcgaagcggcagccgtgcgtgcgcgcgagggccagcgcggcttgcgcgccggagacgaacggcgctgtcacgtcggtgccgttcacgtcgacgatgcgcgcggcgcccgacagcacctgctgacccgatgcgccgccggcgatttcggcgggcgggcgcggcacgctgaagccgccggccagttcggggcagacgggcacgagacgcccttcgcgctgccaccgttcgagtgccgcgtgcgcggcggtcctggccgagccgttgtaacgcaccggatggccgaccacgcacatgctgacgaggatcttcggcatggttggcggctgtgcttcgtcctgcaattttgctctccgtgattgcgcgatggccgatggcagccgaggcaacgcgggacatcccgcgcttcatacgcgtgccggcgcgtcaggccgccggcccttccagatgaatgtcgtccggctcgagcgcgtaaagcgccgggtcgggcgacgcgctgaccgtaaagccgagccgcaggtagaagtcgatcgtgcgctgcgacggcgtcgcggatacatacaggcgtgtggcgcccatcgcgtgcgcctgctcgtgggctgcgcggtagagctgctcgccgagcccgcagccgcgccagtcgcggctcacgtgcaggaacttcaattgcagcatgtcgcgatgcgggccgagcggccggctgtcgacgacgaccgccgcgacgagccgttcgccgtcgaacatgccgaggcaccagccgccgcgatcgtggcagtcgatcaggatcggcgtgtagtggtcggcttcgccttccggccagccgccgacgtcgtagaactccggaacgagatgcagcgcgccgtcgcgcagcacgtacaggtgctcgatgatctcgcgccggtcgatggtccacacgagcggcacttcgtcgcgcgtgagcgggcgtgcgcaaagcgcgtcgcgttcggcggcggtgcggcgcgtcatgcggcctcccgatgcgcggcgatcgcatacatcagcggcaggctcggcatgtgaccgggcggcaccatccggcggccgtccagctcgcgcatgccgtcgaagcccttccagccgttcgaatacggatattcggtcaggcggtcgatcgcgagccccgccgacacgagtgcgttcacgacctcaccgatgccccacatgaactcgtagctcggatgcgggttcgcgaaatcgacgacgccaggatggtcgtgctgcgcgccgagccccgtgccggatacggcgacgtaatcgccgacgcctgtcggctcctcggtcgcgtcgcttttgaaatagtcgtagtgcggcttccactgttcgtcgaaatacagcgcgaacggatggaactcgaccatcgcgaaacggccgcccggcgcgagcagcgcggcgatcccgcgcgcccacgcgttcaggtcggacagccagcagatcgcgccatacgacgtgaacacgcgatcgaagcgctcgccgcgcggcggcctcgggcatccagtcgagcacgtcggcgcgctcgaaacgcgcgggcaggccggcgtcggccgacagttgccgtgcgaaggcgattgcttcgtcggagatgtcgacgcccgtcgcatccgcgccctcgcgcacgaggctcagcgtgtcctgccccgcgttgcactgcaggtgcaggagccgcagcccgccgacgtcgccgagcagttcgcgttcttccggatagagcgtcgagccgcccgcgcggaaaaacgcggcctgatcgcctttgtggctgttatgcgcgactgtcgcggtattccaggacagccgattcagttcgtgtaatgcctttttcatcgaattcgaatgccggttgaatggagcaggataaacggaatcgtttcgccgcgcgcaacggtcgatggcgtgggtctgccgcgcgacgtcgttgcgcagcgtggcgtgacatggggatgaacgctcgcggcgattattgccggattatttgatcgaaatcatggcggcggacgaattggatattttattcgatgaaagggtaaggtttttccccaatatgccgacagtaagatgaagaccgtcgttaagcgataaaccgtttttcggctactgagcgtgatttcagcgcggcgcggacgacagatccgcctttcggagccttgcatgcgcaataaccagcccgttacccaacaggaattcgattttcccgacgacgtcacgctgatgtcgacgaccgatgcagacagcatcatcacctacgccaacacgacgttcgcgcaggtgagcggcttcacgaacgaggaactcgtcggccagccgcacaacgtggtgcgccacccggacatgccgcgcgaggcgtttgccgacatgtgggcgacgctccagcgcggcgagccgtggaccgcgctcgtgaagaaccgccgcaagaacggcgatcactactgggtgcgtgcgaacgcgatacccgtgatgcgcaacggcgagccgcagggctacatgtcggtgcgcacgagggcgccgcacgacgagagcgcggccgccgacgcgctgtatcgcgcgttccgcgacggcaaggccggccagcgccggttccacaaggggctggtgatccgcacggggctgctgcgtatcgcgtcgctgtcgcagacgatgtcggtacgcgcgcgcgtgcattcggcgctgtgcgtgcttgcgccggcggtcgtcggcgcgggctgggcgtgcgggctcgccggtggcggcctcgcggcatttgccggcgtgacggtcggcgtggcggcggcggccggcctgtggctcgatgcgcagatcgtgcgtccgctgaagcggctgcacgaccaggcgctgaacgtcgcgaccggcgaaagccggcgcggcgtgcggatgaaccgcgtcgacgagatcggcatgacgctgcgcacgatcaaccagctcggtctgatgttccgctggctcgtcgacgacgtcagcgagcaggtgcacaacgtgcagcgcgcgagcaacgagatcgcgcagggtaacaacgacctgagcgcgcgtaccgagcaggcggcgtcgagcgtgcaggagacggctgcgtcgatggccgagatgacggcgaccgttgacagcaacgcggagaccgcactgcaggcgaaccggctcgcgatgtcggcgagcgaagtggccggccgcggcgggcaggcggtgggcgaggtcgtcgcgacgatgagcgacatcaccgccagctcgcgaaagatctcggacatcatcggcgtgatcgacggcatcgcgttccagaccaacatccttgcgctgaacgcggccgtggaagcggcgcgcgccggcgaacaggggcgcggcttcgcggtggtcgccggcgaggtgcgggcgctcgcgcagcgcagcgcgaacgcggcgaaggagatcaagacgctgatcggcgcgagcgtcgagcgcgtcgagtcggcgcgcggcgcgtggacgaggccggcaagacgatggaggacatcgtcgcgcaggtgaagcgcgtgtcggatctgatcgcggagatcagctcgtcgacggccgagcagagcaccggggtgtcgcaggtcgaccaggcggtggtgcacctggacaacatcacgcaacagaacgcggcgctggtcgagcagagcacggcggcgtcggagagcctgaagcaacaggcaacgcgtctcgtggatgcggtgaacgtgttccggtgattgtcggggcgcgcacgcgatgtgcgcgcccgatcgatgcatcgtgacatcgtgattgacgcgcgtaatgcgcgttcaggtttttcgattcaatcaaaatacgcgaaacgagaaatattcgtattcaggattttgcattcatgcattgaatcgattcggacgaattacgcggattaatcagacgaatatccgtcaaaccgttgcctggcctggtgtttagtttcatcagtaaacggattgttcggtaaaggcaaggtgatgcatttttaatgcatatttacccgggcaaggcataatgttttcgtaaaagttgccgaaagtgcaggagcatgaccaatgcgcatgcggattgaccgcaatgtgcagggtcgcgaatcaatcgacaagcggacgcaagatccgttacccggagctccacaccatgcgcaacaaccagcccgtcacgcaacgcgaattcgattttcccgacgacgcgacgctgatgtcgaccaccgacgcgaacagctacattacctacgcgaacgcggcattcatccaggtcagcggattttctcccgaagagatcgagggccagccgcacaacgtcgtgcggcatccggacatgccgaaggaggcgttcgccgacatgtgggcgacgctcaagggcggcgagccgtggaccgcgctcgtgaagaatcgccgcaagaacggcgatcactactgggtgcgcgcgaacgcgatacccgtgatgcgcaacggcgagccgaagggctacatgtcggtgcgcacgaaggcgacgcgcgacgagatcgcggccgcggaggcgctctacaaggacttccgcgaagggcgggccggcaaccggcattttcacaaggggttgatcgtccgcaagggcgtggccggtttcacgtcgctgttccagacgatgtcggtgcgggcgcggctccatgcggcgctgtgcgtgtttgcgccggtcgtggtggccggcggctgggcgtgcgggctggccggtggcgggctcgccgcgttcgcggcggtgacggccggcgccgcggtggccgcggggctgtggctcgatgcgcagattgcgcgcccgctcgtgcagttgcgcgacgaggcgttgcgcgtcgcgaccggcgagccgcagcggcgtgcggatgaaccgtgtcgacgagatcggcatgacgctgcgtacgatcaaccagctcgggctgatgttccgctggctggttgacgatgtcagcgaacaggtgctgaacgtgcagcgcgcgagcaacgagatcgcgcagggcaacaacgacctgagcgcgcgcaccgagcaggcttcgacaagcgtgcagcaaacggccgcatcgatggccgagatgaccgcgaccgtgtcgagcaatgcggagacggcgctgcaggcgaaccagttgtcggtgtcggcgagcgaagccgccgggcgcggcgggcaggcggtgagcgaggtggtggcgacgatgaacgacatcaccgccagctcgcgaaagatctcggacatcatcggcgtgatcgacggcatcgcgttccagaccaacattcttgcgctgaatgcggcggtggaggcggcgcgcgccggagatcagggcgcggcttcgcggttgttgccggtgaggtgcgggcactcgcgcagcgcagcgcgaacgcggcgaaggagatcaagacgctgatcggcgcgagcgtcgagcgcgtcgaatcgggtgcgcggatcgtcgacggcgcgggcaagacgatggaggacatcgtcacgcaggtgaagcgcgtgtcggatctgatcgcggagatcagttcgtcgacggccgagcagagcacgggcgtcgcgcaggtcgaccaggcggtggtgcacctggacaacatcacgcagcagaacgcggcactggtcgagcagagcacggcggcatcggagagcctgaagcagcaggcaacgcggctggtggaggcggtgaacgtgtttcggtgatggcgggaacgcgtgaagcaggaggaaggcggcccgcgttgtgcgggccgatttgggcgtgtcctgctacgtcattgcaccctgggtatgggattcaggttcgggcaacagtggttggggcaccccggactgacgttcacttcaacgcgtcgcccggattgaccgaattcgtccggcttgaaaatcttccccgccagggcgcttttctcgccacggatcgaatgccgatccagaacagccatcacgttttccgctcgttgcgttgcgagctgttgcgcgttgttctcggttcgttcggccagtccgataagccataccgtatcaatgatcggaaagcgcttgtgcatgtcgctcgaccatgccgacatcctcgagagttcggtcggagaaatcgcactcgaatccgcatcgaaaacaatatcgatgtaatgggcgggcatgttcgacgcaccgtcacaggcgaacgctgcctgtgcgcaactcaacgcgagcgcggcggcggtcaggagtttagtcgccattgatatcgtacccgcagcgctgttggcatttttgaatgaggacacctgcatccgggatgcgttccatggtcagcgattgatgagtttgctgtgtggcgctactcgtgggtcgtcgcacatccatgcgcagctacctttatctttgattcgtgatactgctagccgaacgagtcactgcagaatttcgaatagccggcaatgcctcgcttgtgcgggctgggttcgcatacgacggcgtgattttggccgctgtccggcaggcttgcacaattggattcctgttgtcggagagtctgaagcagcaggcgacgcggctggtggaggcgctcaacctgttccgctaatcgcgggaacctgcgaggcaggaggaagacagcccgcatcgcgcgggccggcgtgggtgcgtcgtgttacctcattgcgccctgggtgtgggattcaggttcgggcagcagtggttagggcatcccgggccgaatgtgatctcgacgcgccgcccgttgtcatcaaactcgctcgcaggaaacggcagcttgtagattcgcgcgatcatcgaatttcgttcgccccgaatcaagaattgatctagcgcgcttttgacgttcgctgcgcgtcggtgcgcaagctcttgcgcgcttcgttccgtcggctcggccaatccgacaaccgacaccacatcgacaatggggaagcgattgcgcatgttgttcgaccatacggagagcttcgccagttcggaggtagataggtcgcttgaattgttgtcgaatcgaacatcaaaatcccaaccgggcatgttcgacggaccatcgcatgcgaacgccgtatgtgcgcagctcaacacgagcgcggcggcagtgacgaccttattcaatgtcaacaacgtaccccgcgatgctgtcggcattgttgattgccaagtctgggtttgaccgtccccaaccggggagcaagggcgtaatcgtgtattggtcatcggtcgacgacatggtgtcttggaaatgggtggcttcgtgaatgatagttgacacgtgcgaatcagcgttcgctgtccacgggcgcatcgtgcagaatcgcccactgatggcgatcgtgtgtgtgccgtgtccggcgcgcatacgtgggcggcctcgtttgtcgttcctcgtgggtgaggcgtgcaacccgtcgcaagatcgccagcgctgccgcttcgaaccacattgttctcgttgaatgctcgaaccacggcaagcactttcgtcaggccggtgagtaggtgcatacgcgtgcgctcgtcgtttcgaccgaaccatttgaatacccggcccttatcgaccttcgaccacttttgtaaatcagcaatgcggatcgtcaaccggtcaatcgctcgtccttgcgctacggaaaaaccttgcggaattccgaattggtcatgttttcgcagatcggtcgcaagtcaacatcggcaaatgtctgcgattctgcggtggtgtttgttgttgtctcggcgacggtagtttggtttcccatcgtttcagtcctcgattacaagcttcaatgcttccgcatgttcggttcgtacgcgcacggtacagccgtgccgatcactcacgccggatgcatgcacgtttccggatcgatccttgatccagtagcgcacgttgcttaacggttgcttcgtcctcacgtcgcggatcacaaattgaccgctgtaaatgtccgatgccggcgcgtaccgcgtgggtgggaatgccgaatatccgatgaagggggtagccgagccatggccgccgctgtcttcaatgaaaaacatgcagtcgttgctcgcgactaaaaagttttgaccgcatggacaaagtaccgcgtcgccctcgacggctacggcacgtccgtcaccgacgacggataccgcgcttcccgctatcgggaaccttccctcgcaatttccacacgtcgctttgtcgccatccaaggcaatgtgcttgtcgtccacgaatatgcttgcagtgcctgcgataacgattccacctgtcgtcgttgcgtcgccgttcctgatcgctcgtcggctcatggctatgtcctcaatcgaagttggtaaagacccaatcggctgactccgggtcataaatcgcgtattggtcgatcgtgaaattttgcgaaggcaatggtcgtaggcgtgcgcgcgagtgcttctgtttccgcatcggcctgcgaggtgtgtcgctgctgcaccatcgcgtaaagccggatcgatgagcgaataaagtacgggtaggcggcatgttcttcttccatggactcggataccttgtgtatggacgagccatagacagtggccggtaagactttctctgtctatagaacgagtacgattcttattttggagtccgacggagattgatgacaaaaagcgatcatcgaggccgacgcgaaggggtatcgagcagaacgcggccgagcgttatacccgcccgtccgtcaagtcggagactattaacgtatgtcacggcaccacccgctgcagcggttcctgcgtgcacagactctgcacactgggggccgtaggatgtcgtgttcatgcgcgtgcaaaccggatcgagacggagcgctcaatctggcgtcgtgcagagaagtgagaaatgagactgaaacgcaattcgcgcgcgatatgacgtatcggcggatacagcgatcgaaacagggtacgcagagcggggcgacttcgtgcgtatcgagacgacgcgggcacgacggagagggcgccggcccgcgtcggaccgcccggttccggccgggcggtcagggcctgtcaccgaagcggtgccaggccctgaaccgtcagacggcgaggcagaggtacttgatcacgacgtagtcgtcgatgccgtagtgcgagccttcgcggccgaggcccgattgcttcacgccaccgaacggtgcgacttcgttcgagatcaggcccgtgttcacgccgaccattccgtattcgagcgcttcggcgaccttccacacgcggccgatgtcgcggctgtagaagtaagcggcgaggccgaactcggtgtcgttcgcgaggcggatcacttcatcgtcgctgccgaacttgaacagcggcgcgagcggcccgaacgtctcttccttcgcgaccttcatcgccggcgtgacgcccgtcagcacggtcggctcgaagaagccgtggcccagcgcgtggcgcttgccgcccgtcacgacggtcgcgcccttcgcgagcgcgtcctcgatgtgcgcctcgaccttcagcaccgctgcttcgttgatcagcgggccttgcgtgacgcccggctcggtgccgcggcccaccttcaactggccgacggccgcggcgagcttctgcgcgaactggtcgtacacggcttcatgcacgtagaagcggttcgtgcacacgcaggtttggccgctgttgcggtacttcgatgcgatcgcgccctgcacggccgcgtcgagatcggcgtcgtcgaacacgatgaacggcgcgttgccgccgagctccagcgacaccttcttgaccgtcgccgcgcattgcgacatcagcaggcggccgaccggcgtcgagccggtgaacgacagcttgcgcacgatcgggttcgacgtcagctcgccgccgatcgccttcgggtcgcccgtgacgacgctgaacacgccggccggcacgcccgcacgctcggccagcacggccatcgcgagcgcggagaacggcgtcgcctcggccggcttcacgacgatcgggcagcctgcggcgagcgccgggccgaccttgcgcgtgatcatcgccgccgggaagttccacggcgtgatcgccgcgcacacgccgatcgcttccttcgtcacgacgatgcgcttgtcgctcgccggcgtcgggatcgtgtcgccgtacacgcgcttgccttcttccgcgaaccattcgaggaacgatgcggcatagccgatctcgcccttcgcttcagccagcgacttgccctgctcggtcgtcaggatcagcgcgaggtcgtcggcgttttccatcatcaggtcgtgccacttgcgcaggacgaccgcgcgttccttcgcggtcttcttgcgccacgccggccatgcggcgttcgcggcttcgatcgcgtgacgcgtctcggccgtgcccatcgccggcacggtgccgagcaggccgcccgtcgccgggttgcggacttcgaacgtctcgccgttcgtcgcgccttgccattcgccgttgacgtacgcctgctggcggaacagcgacggatctttcagtgccagggtttcctgaacagtgctcatatgaatcgcctgctttgaagatgacggataaaggccgccgccgtcgtgacgacggcggcggcgcattcggaaggcaggaactcaggcgggcacgccgaccgtttccttcagcacttcctcgaggatcacgagcgcttcatcgaacacggcttgcgtgatcgtcagcgggaacaggaagcgcacgacgttcgagtacacgccgcacacgagcagcagcaggccgcgctcgagcgcacgcgtctgcacgcgcttcgtgaactcggcatccggctcgcccgaacccggcttcaggaactcgaccgcgatcatcgcgcccgggccgcgcacgtcggcgatctgcggcacgtcggcctgcagcgcgttcagcttcgccttcagcacgtcgccgagttgcgtcgcgcgctcgcacagcttctcttcgtcgatgatctcgagcacggcgtgcgccgatgccacggccagcgggttgcccgcatacgtgccgccgaggccgccgggcgctgccgcgtccatcaggtcggcacggccgacgacgcccgacagcggcatgccgcccgcgaggctcttcgccatcgtgatcaggtcggccagcacgtcgtagtgctgcatcgcgaacagcttgccggtacgcgcgaagccggtctgcacttcgtcggcgatcagcaggatgccgtgttcgttacagatcttgcgcagcgcgcgcacgaattcggccggcgccgggttgaagccgccttcgccctggaccggttcgaagatgatcgcggcgacgcgcttcggatcgatgtcggccttgaacagcatctcgatcgccttgatcgagtcggccgtcgtcacgccgtgcacggcgttcgggtacggcgcgtggaacacgtcgcccgggaacgggccgaagttcagcttgtacggggcgaccttgccggtcagcgccatgcccatcatcgtgcggccgtggaaaccgcccgagaaggcgatgacgcccggacggccggtggccgcgcgtgcgatcttgatcgcgttctcgacggcttccgcgccggtcgtgaagaacgcggtcttcttcggaaatcgcccggcgcgcgtgcgttgatcttctcggccagctcgacgtacgacgcgtacgggacgatctggtaagcggtgtgcgtgaagttgttcagttgatccgcgatcgccttgacgatcttcgggtggcggtggccggtgttcagcaccgcgatgccggcggcgaaatcgatgaagcggcggccttcgacatcccacagttccgcgttctcggcgcgggctgcgtagaaatcgcacatcacgccgacgccgcgcggggtggcggcgttcttgcgggcctgcaggtcggcattcttcacggtcatctccttgatgttctttccggtgaggtgaaaatcgggcgcttcgacagcccatggaggcgactataatcacatttggctctggcaatcagagccatttcaataaatattcaggagccaatcatgcgcgcgagcgtgttgtcggactggctggcgcagcgcctcgtgcgaggcggcgaacagccgatctaccggcagcttcaccggctgctgcaacaggcgatcctgtcgcgtgaactgccggccggcacgcgcgtgccgtcgtcgcggctcctcgcggccgaactcggaatcgcgcgcaacacggtcacgcaggtttacgaacagctttcactcgaaggctacgtgaactcggcgaccggccgcggtacgttcgtggccgacagcgcgcccgacgagatcgtcggcgcgccgcccgacgcgaccgccacccacccggcgctcgtgcagccgtccgcgcggcggctgtctgcgcgcggtacgcggctcgtcgaaggggccggcgtgtcgaaacggcagggcggcgcgttcatgccgggcgtgcccgatgtgtcgcgctttcccgctcgcgtgtggacgcggctgcacaacaaatactggcggcggttgcgccccgacctgctgacctacgcgccgggcggcgggctcgcgctgctgcgcgaggcgctggccgattacctgcgcacgtcgcgctcggtgcgctgcacgcccgagcagatcgtgattacgaccggcatccaccagtcgatcgacctcgcggtacggctgctgaccgacccgggcgacgcgatctggaccgaggatccatgctactggggcgtgcgcagcgtgctgaacgtgtcggggctgacgacgcggccgatcccggtcgacgaggaaggcatcgccccgtcggcggccgatctcgccgaaccgccgaagctgatgctcgtcacgccgtcgcaccagtatccgctcgggatggtgatgagcctcgcgcggcggcggatgctgctcgaatacgcacgccagcacggttgctggatcatcgaggacgactacgacagtgaattccgctacggcagccgcccgcttgcgtcgctgcagggctcgacacggccgggcaggtgatctacgtcggcagtttcggcaagacgctgttcccggggctgcgggtcggctacctggtcgcgcccgagccgctcgcggaaagtttcgcgaccgcgagcgccgagttgtaccgcgaagggcagttgctgcagcaggcggtgcttgccgaattcatcgcggaagggcacttcgtgtcgcatatccgcaagatgcgcacgctgtacggacagcgccgcgaggtgctgctcgacgcggtcgcgcaacgctatggcgacacgctgcacgcgctcggcagcgatgccgggctgcatctggtcacgcagttgccggaaggcgtcgacgatcgtgcggtcgcgcaggccgcgcttgaacgcaatatcgtcgtgcgaccgttgtcgggttattacgcggaccgcgaacgcgcggcgccggggttgctgctcggttatgcgtgcgtgccggaggacgagatcgcgacggcgttcgcgacgctcgccgaggcgatcgacgagcgggcattcggcggggcggcggtcgcggtctgacgcctggcaggtcggcacgacctgcagacgaacgcgtgtgtcgcgcgccgcctacaggcggatcagcgccgcgcccacgaccaccagcgcgcacgcggcaagccgctgcgcgccgggccgctcgcgcatcacgagccagccgatcgcgaccgcgaagatcgaactcgtttcgcgcagcgccgacaccgtcccgaccggcaggtaccggtacgcgaggatcacgattccataagcggcgagggagatcgtgccggcgatcgcgccctgcgtgagcgccgtgcgcgaggcgagcaccgcgcgcgggccgccacgtaccgcgcagaccagcacgaactgcggcacgctccacagcacgtacacccacgcgatgtagccgagcgcgctgccggatacgcgcgagccgatgccgtcgcagatcgaatacgcggcgatgaacacgcccgtgagcagcgcaaacggcacgccttcaccagagaaccggaagcctcgccgcagggcgagcgacatgatgccgaacgacacgagcgcgatgcccgcgaagccgaacggggtcggctgttcgtggagaaaggcgagcgcgagcaccgacacgagcagcggcgagatcccgcgcgcgatcggatagatctgcccgaactcgccgctgcggtaggcgcgcgccagcgtgaagcagtacgcgacctcgagcgcggccgacgcggcgatatacggccacgcggcgggtgccggcgcgggcagcagcgcggcgccggcgacgccgaacgcgaaatagggcagtgacatcgtgccgagctgtacgagccggtcttcgctgacgtggaggaaggcattccagatggcgtgcagcaacgcggagcacagcacgaggccgatgaagaggtgatccatggacggaaggtgcgggcggcagcgggagcgggagtgcgccgccattatgtgggtatcgggcgcactcgcacggaattgtcgataatgtcgtgttgttattcaccggatgccgacgatgaccgaagccacccaagcccagcctgccgttccgcgcctcacgagcctgtcgcacggcggcggctgcggctgcaagattgcgccgggcgtgctgtccgagctgctgaagcgcgcgacgccgcccgcgctgttcccggatctgctggtcggtaccgagacgtccgacgacgcggccgtctaccgtctcaacgacgagcaggcgatcgtcgcgaccaccgacttcttcatgccgatcgtcgacgatccgttcgacttcggccgcatcgccgcgaccaacgcgctgtccgacgtgtatgcgatgggcggcaagccgatcctcgcgctcgcgctggtcgggatgccgatcaacgtgctgccgcacgagacgatcgcggccgtgctgcgcggcggcgaatcggtgtgcgcggacgccggcattccggtggcgggcggccattcgatcgattcggtcgagccgatctacgggctcgcggcgatcggcgtcgtgcatccgtcgcgcgtgaagcgcaacgcggccgcgcgtgcgggcgacgtgctcgtgctcggcaagccgctcggcgtcggcgtgctgtcggccgcgctgaaaaagaaccagctcgatgccgcgggttacgcgcagatggtcgcaacgaccaccaagctgaaccgcccgggcgccgagctcgctgcgctgccgggcgtgcatgcgctgaccgacgtcacgggcttcgggctgctcggtcatacgctcgagctcgcacgtggcgcgcaccttaccgcgcgcgtgcactacgcgtcgctgccgtggctcgcgggcgtcgaggcgttcgtggccgacggcgtgttcaccggcgcgtcgggtcgcaactgggccgcgtacggcgcggacgttcaactggccgacacgctgccgcccgtcgcgcaggcgctgctgaccgatccgcagacgtcgggcggcctgctggtcgcgtgcgcgcccgaggccgtcgacgacgtgctcgcgtgtttccgtgccgacggcttcgaccgcgcgggcgtgatcggcgagatggtggacgggcctgcgcgcgtcgatgtcgcgtgatgccgaatcgccgcaccggagatttttgcgttcgctagaatcggtgccttcgatcgaaggcatcgacgaccgatgaacgatttcctgttcgggctgatgatcgcgctgtcggtcgggcccgttgcgctgatgatcgcgaactacgggatgcgcgccggcaccgcaagcggcgtgcgcgcggcggtgggtgtcgcgacggccgacggctgctacgcggtcgtcgcgttcacgctcggcgcgatgctggcgagcacgctcgcggcgcatctgtcgctgtttcgtctggtgggggcgctcgtgctgctcgcgatgggcgcgcggatgctgtggcaggcgttgcgggatcgccgccgcacgctcgacggcgatgcgcggccgccgggcagccgcccgtttgcatcgatgttcttcgtcacgctggcgaacccgctgacgatcctgttgttttacggctatgcaacggccgccgccggcgcgcagcggcactggctgctcggtgccgcgtgcgtgtttgccggcagcctcgcggggcagctggtgttcgcattcggcggcagcgtgatcggccggatcgtgaagtcgccggggctgctcgcggcgagccacgtggtcgcggcgcttgtcgtgctggggtatggggtggcaggactggcacggctgtagcggtttgccgggcggcgggcacgcaagtgcgatcgacgtgtcggtggcgatcaaccggatagtattcctgacggtatgtcgacgtgcggagcgaatttccgttgtgcttcccgcgtgcgctgcacccgaaccgacgcaccggccgtcgtttcgtagtcgggttccgcaacgcgcacgcccgttctatactccgtcgcgcagtctacgagagccgttctcacccaacatcatcgaaacaaggaacgccgatgctgactcgctccattctttccgccgctgcattctcgctcgcagcctgtgcaaccgcgccgtcgatcgcgcaggacaaccagggcaacaacgcgggcaacaatgcattcgccgagaccggtgcacagggccgcccggtcaaggtcatgatcatcacgatgttcggtccggaaggccaggcatggctcgaccggctcggcccgtggcgcgacatcgccgtgccgggcctgtcgcccgactacccgaacgttcattgcaacaagcaggacgtgtgcgtggtcacgaccggcatgggctatgcgaacgcgtcggcgacgatcatggcgctcacgttctcgcagcgcttcgacctgcgccgcacgtatttcctgatctccggcatcgcgggcgtcgaccccgcgcaaggcacggtcggctcggccgcgtggtcgaagtacctcgtcgatttcagcctgcagtgggagctcgatgcacgcgagattccggccggctggaataccggctttctcggcatcaacacgaagagcccgaacgacaagccgccgctcgactatcgcaccgaggtgttccagctcaatccgcaactgaccgacgccgcggtcgcgctgtcgcgcaacgtcgtgctcgccgacagcgcgcaggcgcaggccgcgcgcgcgaagttcacgtatgcgccggcgaaccggccgccgacggtgatccagtgcgatacgtcatcgggcaacacgtggttctcgggcacgctgatcggcgagcgcgcgcgccagtggacgaagatactgaccgacggcaagggcacctactgcatgaccgcccaggaagacaacgcgacgtatgaagcgctcaagcgtgcggcgagcgtgaagcgggtcgacctgtcgcgcgtcgcggtgctgcgtaccgggtccgatttcgaccggccgtatgcggggcagacgagtgccgacaacctgctgaactacgcggaccagggcggcttcgctccggcgaccgaaaacctgtatcgcgcgggcaatccgctcgtgcaggacatcgtgacgcactggggcgagtggcgcgacgggtgccgcgccgttgagggccaggcgacggctcagtcggtggtcaatgcgagtgcggggccgaacggaaaggcgtccagaccggcgtggtgtcgtcccagtgatcgagcggcgaaggaagttggtcgttcatcatgtgctcctgcaactgactgactcggcgagtcgtcgatagctgtgtcgcgacgccgcgcacggggcacccgctgcgcggcgttgcacgtttagcggcccccgccggcgagctggttgctttccggcatcgagcgatacgggccttgcgcgagttcgagcccttgcgggtacgaatttgccttgcgcaggtacgcgagcgtgccgtccttgcgggcctgctcgacttccgcgctgacttcggcgcgcgtgcgcgggccgtagtgctgcgagtaccacgacgtattgccgtagtcgccggcatgcggcgtacccgaatcggcgaaggccggggcggacacggcgagcgtgagggccagggcggagagaaggtggcggcggttcatggtgtagctcctgtgtcgatatgagttagcgcttcagcgcttactcagatcccatgctttgcggtcgatatgagttagcgtttcagcgcttacccagatcccatgctttgcactgtcggagctggcgcttgagcgcttgccccggtcccatcaagcgggatctgttcgatgcgcaacgaggtgcgcgacagggtttactctaggtatctgttccgtcgcgataaatgcggcagacgcgaattgaattgtcgcgatggcggaacaatcgaaagccgcacaggtagtggggatacgggacgccttgctggccgggggcggcagcggaattcgaccgatcgggcgaggcgtcgcgcggcgatcaatccgaatgacgcaatagtcttctgcacgcggtggtgcaatgccgcacaccgcgacgcgccggtgcatgcggcggccgacgaacgcggcagcccggcgatgccgtccgagagcggaacgggcgtggccgccgtcgagcgtcagatcgcttcgagccgatagccgagcgtatagaccgcgctgagccgcacgccgttcgacggctggagcgccatcttcatccggagtcgatagatgtgcgtgtcgaggctacgcgatacgccggtcatgtcgcgaccccacaatgaaaggatcagcgcgtcgcgcggcatgatgcggccgaggttgcgaaacagcagcacggcgagatcgaattcgcgcggcgtcagccggacatgctcgccatggagcagcacggtccgcgccttcgtgtcgatccggtagccgccgatatcgagggcgtcctgcggcgcgccgccgctgtgatacgcgcgccgcagcagcgcgttggcgcgggccagcagttcgaattggttgatcggcttgaccatgtaatcgtcggcgccggcgttgatcgcggagaaaatctcgtcgtcccgaacgcgactcgtcaggaacaggatcggcaagcgtccgccgatgcgctcgcgcgtccatttcagtacctcgaaccccgacagccccggcacttgccagtcgagaatcagcaagtcgacgaccgcgttctccaggtgacggatcgcgtgacagccgttgccgaccgcatgcacgcggtgtccggatttctcgagtattgaagtgatcatttcgacatatgcgttgtcgtcctcgagatataaaacgttcatgattcgcactcctttgttagcgagcaggtcgatcgtgctgcatcgagcgtgggtcggaggattctgacgaacggtgcgagggtgggcggccggtggtttgccgcgcatgttcgcatcgtttcatgttcgtaattgtcaacaattttgaacgcataaaacatgctaatcataggcaaaaacagcctttaacgacgtatgaatcatctgttttcaacgattgttgttgacaaacgttgtcaatacgaagcggcagcgtgattacgcttggatgtgccggcaacgtctcggtgaagtcctgtaaagagccgaattgaggggaaaatcgcatgctgatatacaagtcgttcatggagaaaaaggcgctgctcgaagagcagctcgaacgcgagcgtctcgccatatcggagacggtgctgctcgaagtccggcgctgcatcgaggaattcgggttcacgtacaaggatgtattcccggcaggtgcggccggcgcccggaagcgcagggcaaagtatttcgacccgcggacggggcagacgtggtgcggcgtgggccgcgagccggcatggctgcgtggtcaggatcgcgaccggtttctgatcgacaggtcgtcgttcgagcagtcgcagggtcaggattcctgattagtgagcggatgaaagggcgttgtcttgtcatgcgggtatcggggtgtcgatgcgagggccgggtaccgtcggcatggaacacgccgagggccgaccgcgatggctcgggttgagccgcgccgcgaatggaaccggttctgtccgtaaatattacatttagattatgacagttctagtggcgaacaataacgccccatttttcttgtcttcgaccggatcgcaagacgagcccgacgggcagattcgtatgaacaatgaggcggcagcgcgacagcacggcgacgaactgacgccggagcgcgtattcgtcggcattagcgtgacgcgcgagatcctcgaggtcgacgtctcgtcgttgcgagtgattctcggttaccggaacgagacgtacggcatcgagtcgctgaccgatgcgattgccgaatgggcgccggcgcgcatcgtgctggagtcgtccggcggtgccgagtcccacgcggcatgcgcgttgcaggcggcgcgactgccggtggccgtcgcccacgcgcatcaggctcgcgatttcatcgcgggggcggccgggatgccgcccgaaggcaagggcgcgcgtgcccgtctgctctcgtcattggcccgcgagttcgaccggtatccgatgtgcgcgcggctcgccgaaccgttgtcggatccgccgctgcagtatgttcaggcgttggtgcagcgccgccggcaactcgcgcgcacgatgatggccgaatatcaagtgctcgcgcgatcgcacgcgagcgtgcgcggcggcatcgagcagaccatcgcgttcctgaaaggccaactcggcgtgatcgaccgctattgcgctcggcacgtaagcgcgcagcgtgcggaactcgcgcgggcgatggcgcgcgcaaggcggccgggcagttgcgcgccaggcacggggccgcggagttcatgcgcacgtggcgaacgaagtgacaggcgtgcgcgggagcgtcgcgcctacgcgacccattcgttgatgaccggcgtgtcgagcaccggcgcgcgttcggcttcctcgaacgtacgcttgctgcacgtcgcgtcgaggctgcccttgccgctcagcagcgggcaacggtcgaacacctcggcgatccagtcgacgaatacgcgcactttcggcgacagatggcggctgtgcggatacacgacggagatcggcatcggcagcggcttgacgccgggcagcacttccttgagccggccttcgcgcagatgcggcagcaccatgaagagcggcggctggatcagcccgaagccttcgatcccgcaggtcacgtacgcatcggcatcgttcaccgacacgatgccctccatcttcatctcgacttcctggccgtcggtcaggaacgtccagtcgatcgtgcggccggtgcggctcgagaagtagttgacggccttgtgctggctcaggtcgtcgatcgtcttcggctcgccgtgacgctcgagatagtcgggcgacgcgaccgtcacgcattcgaacaggccgacccggcgcgcgacgagcgacgagtcctgcaatgcaccaacgcggatcacgcaatcgaccccttcctgcagcaggtcgaccggccggtcggacaggccgagctgcaggtcgatgtccgggtagcgcgtatgaaattcgcacagcgacggaatcacgagcagccgcccgatcgagcccggcatgtcgatacgcaactttccgtgcggcttccggttgttcgcctggaagctcgcctcggtttcctcgacgtccgcgaggatccgcacgcatcgttcgtagtaggcggcgccgtccggcgtgagcgacagccgacgcgtggtccggtgcatcagccgcacaccgaggaatgcttcgagattctggatgatcgtcgtgacggacgcccgcggcaagctgagcgtttctgctgccttggtgaagctgcttgtatcgacgacgcgagtaaacacctgcatggcctgaagccggtccatcacaacctccgcaatctaatttgccgccggaacaagaaggctgcgctacctcgtgggtaaacgcagcctcggattgttcggggcgttgaattgtgttgccggattataggcatttatcccaatgtctgccggacccagaattcgttccatctcgaaatggatgctgcatcgtcatggacgcttctgaattcagcaaattcctgaaggccgcgttgcccgcgcaagccacggcgggcgcggcgctgacggtcgccgaagtggaaattcccggctacgcgcaggacatcgtgctgcgcctgtaccggcgcccggacaagaccgggttgccagtagtgctttacttccacggcggcggcttcgtccgcggttcgctcgaagacgccgatttcgctgcgcgtttttagcagaacgcttaccagctctcgtagtgtcggtcgactattcgctcgcgccggcctttccctttccggccgcgccggaggatgcgtatcgcgccgccgtgtgggccgcgacgcgcgcccgcgcgttcggcggcaacccgaagaagatcggtgtcgcgggtcacgacgcgggcggccagctcgcgaactgcctcgcgttcatcgcgcgcgatcgcggcgaagtgtcgatcgtcgcgcaggcgctgttcgggccgatgctcgacccgagcatgacgcgcatcggcgacgccgagcgcctcgcgtccgacatcaccgcgcgcgaatgcgcggcctgttatcgcgcgtatctgccgcaggccgcgcaacgcatgcacccgtatgcggcgccgctcgaatcggtgcgcctcgcgggcctgccgccgacgctcgtcgtcaccgcgcagaacgacgtgctgcacgtcgaggcggagaaatatgcgggctgcctgatctcgtcgggcgtgctcacgcaggtgatccgctatccggacatcacgcacgccgcgctcgcgacgcacgaagccgccttcgaggaagccgtgcgcttcttccagtgccgcttccaggcgcgccagcccaaccgttccgaataaccagaaccaatccacgtttacctggagatccacatggccatcctacgcacctcccgttcccgaatcgcgacagcggcgatcgtgacgcttgccgtcgtcggcctcggaacgttcggcgcgatgcgcgtgaacgcgaacgcacccgagaaagcggctgcaccgctgcccgaagtcgacgtcgcgaccgtcgtgccgcagaccgtcaccgactggcagagttattcgggccgcctcgaagcggtcgagaaagtcgacgtgcgcccgcaggtgtcgggcacgatcgtcgcggtgaacttcaaggacggcgcgctcgtgaagaagggcgacgtgctgttcgtgatcgacccgcgcccgtaccaggccgaaaccgatcgcgcggccgcgcagctcgcggccgcgcaagcgcgcaacggttacgcgcagaccgactggcagcgcgcacagcggctgatcggcgacaacgcgatcgcgaagcgcgattacgacgagaagcagaatgcggcgcgcgaagcggccgcgaacctgaaggccgccgaagctgcgctcgaaacggcgcgcatcaacctcggctatacgcggatcaccgcgccggtctcgggccgcgtgtcgcgtgcggaaatcacgctcggcaacgtcgtgtcggccggtgcgtcggccgcgccgctcaccacgctggtgtcggtgtcgccgatctacgcatcgttcgacgcagatgaacagacctacctgcaatacatcaacggcgcgcgcaacggccgcaaggtgccggtcgagctcggcctcgcgaacgaaaccggctactcgcgcagcggcgagatcgactcggtcgacaaccggctcgacacgtcgtcgggcacgatccgcgtgcgcgcacgcttcgacaatgcggacggtgcgctcgtcccgggcctgtacgcacgcgtgaaggtgggcggcagcgcgccgcacgaggcattgctcgtcgacgacgcggcgatcaacaccgaccaggacaagaagttcgtgttcgtcgtcgaccagcagggccgcgtgtcgtaccgcgaagtgcagcaggggctgcagcacggcaaccggcgcgtgatcgtgagcggcctcgcggcaggcgatcgcgtggtcgtgaacggcacgcagcgcgtgcgccccggcgaacaggtgaagccgcacatggtcccgatgacgggcggtgacgcgccgtccgcgccgctggcggacaacgcgaagccggccgccccggcgaaggcggattcgtaagcggcccgccgcttcgcatccgcgttcaaccagacagagccacacatgaacatttcaaaattctttatcgaccggccgatcttcgcaggagtcctatcggtgatcatcctgctcggcggggtgatcgcgatgttcctgctgccgatctcggaatatccggaagtcgtgccgccttccgtgatcgtgaaggcgcagtatccgggcgcgaacccgaaagtgatcgccgagacggtcgcgtcgccgcttgaagaacagatcaacggcgtcgaggacatgctctacatgcagtcgcaggcgaacagcgacggcaacatgacgatcaccgtcacgttcaagctgggcaccgatccggacaaggccacgcagctcgtgcagaaccgcgtgaaccaggcgctgccgcgcctgccggaagacgtgcagcggctcggcatcacgacggtgaagagctcgccgacgctgacgatggtggttcacctgatctcgccggacaaccgctacgacatgacctacctgcgcaactacgcgctgatcaacgtgaaggatcgcctgtcgcggatccagggcgtcggccaggtgcagctgtggggttcgggcgactacgcgatgcgcgtgtggctcgatccgcagaaggtcgcgcagcgcgggctgtcggcggaggacgtcgtgcaggcgatccgcgagcagaacgtgcaggtcgcggccggcgtgatcggcgcgtcgccgtcgctgcccggcacgccgctgcagctgtcggtgaacgcgcgcggccgtctgcagacggaagacgagttcggcgacatcgtcgtgaagaccacgccggacggcggcgtcacgcacctgcgcgacatcgcgcggatcgagctcgacgcatccgaatacgggctgcgctcgctgctcgacaacaagccggccgtcgcgatggcgatcaaccagtcgccgggcgcgaattcgctgcagatctcggacgaagtgcgcaagacgatggccgagctgaagcaggacatgccggcgggcgtcgactacaagatcgtctatgacccgacgcagttcgtgcgttcgtcgatcaaggccgtcgtgcatacgctgctcgaagcaatcgcactggtcgtgatcgtcgtgatcgtgttcctgcagacctggcgcgcgtcgctgattccgctgatcgcggtgccggtgtcgatcatcggcacgttctcgctgctgctcgcattcgggtattcgatcaatgcgctgtcattgttcgggatggtgctcgcgatcgggatcgtggtcgacgatgcgatcgtggtggtcgagaacgtcgagcgcaacatcgaaagcgggatgaacgcgcggcaggcgacctacaaggcgatgcaggaagtgagcgggccgatcatcgcgatcgcgctgacgctcgtcgccgtgttcgtgccgctcgcgttcatgtcgggcctgaccggccagttctacaagcagttcgcgatgaccatcgcgatctcgacggtgatctcggcgttcaactcgctgacgctgtcgccggcgctgtccgcgatcctgctgaagggccatggcgacaaggaggactggctcacgcgcgtgatgaatcgcgtgctcggcggcttcttccgcggcttcaacaaggtgttccatcgcggcgcggagaactacggccgcggcgtgcgcggcgtgctgtcgcgcaagaccctgatgctcggcgtgtacctcgtgctcgtgggcgcgaccgtgctggtgtcgaaggtcgtgccgggcggcttcgtgcccgcgcaggacaaggaatacctgatcgcattcgcgcagctgccgaacggcgcatcgctcgaccgtaccgagaaggtgatccgcgacatgggctcgatcgcgctgaagcagccgggtgtcgagagcgcggtggcgttcccgggtctgtcggtgaacggcttcacgaacagctcgagcgcgggcatcgtgttcgtcacgctgaagccgttctcggaacggcacggcaaggcgctgtcggcgggcgcgatcgcgggtgcgctgaaccagcagtacagcgcgatgaaggactcgttcgtcgcggtgttcccgccgccgccggtgctcggtctcggcacgctcggcgggttcaagatgcagatcgaggatcgcggcgcggtcggctatgcgcggctcgcggatgcgaccaacgacttcatcaagcgcgcgcagcaggcgccggaactcggcccgttgttcacgagctaccagatcaacgtgccgcagctcaacgtcgatctcgaccgcgtgaaggcgaagcagctcggcgtgccggtgaccgacgtgttcaacacgatgcaggtgtatctcggctcgctgtacgtgaacgacttcaaccgcttcgggcgcgtgtaccaggtgcgcgtgcaggccgatgcgccgttccgccagcgtgcggacgacatcctgcagttgaagacgcgcaacgacaagggcgagatggtgccgctgtcgtcgctcgtcacggtgacgccgacgttcggccccgaaatggtcgtgcgctacaacggctacacggcggccgacatcaacggcggcccggcaccgggcttctcgtcgggtcaggcgcaggccgcgatcgagcgcatcgcgcatgaaacgcccgcgcggcgtgcggttcgagtggaccgacctcacgtaccagcagatccttgccggcgattcggcgatgtatgtgttcccgatcagcgtgctgctcgtgttcctcgtgctcgccgcgctgtatgaaagcctgacgctgccgctcgcggtgatcctgatcgtgccgatgagcattctgtcggcgctgacgggcgtgtggctcacgcagggcgacaacaacatcttcacgcagatcggcttgatggtgctggtggggctgtcggcgaagaacgcgatcctgatcgtcgaattcgcacgcgagctcgaacacgacggcaggacgccgctcgaggccgcgatcgaggcgagccggctgcggctgcgcccgattctgatgacgtcgatcgcgttcatcatgggcgtcgtgccgctcgtcacgtcgacgggggccggttcggaaatgcgccatgcgatgggtgtcgcggtgttcttcgggatgctgggcgtgacgctgttcgggctgatgctgacgccggtgttctacgtcgtgttgcgtacgctggcaggcggcaagatccacgtcgccggcaaggactcgtccggctacggcgtgccggcccagggcgtaccggcttcggatgcttgaggataaaaagatggacaacatgcacaacacgaacggcctgatgcgcttcgcgaaggtggcggccgcgagcaccctgctcgcgacgctgctcgccgcgtgcgcggtgggccccgactacaagcgcccggatgcggcggtgcccgccgcgttcaaggaagcgccggcgctcgccgccggcgagcaggccggcacctggaagacggccgagccggcggacggcgaacatcgcggcgaatggtggaaggtgttcggcgatccggtgctcgactcgctcgagacccaggcgctcgccgcgaaccagaacctgaaagccgcggcggcgcgggtcgaggaagcgcgcgcggcgacgcgttcggcgcgctcgcaatggttcccgcaggtcggcgccgggttcgggccgacgcgcgaagggctgtcgtcggcgtcgcagttccagccgcagggcacgggcccgaccaatgcgacgctgtggcgcgcgcaggggacggtgtcctacgaagccgacctgttcggccgtgtcggccgcaacgtcgaggcgtcgcgtgccgaccaggcgcagagcgaagcgctgttccgttcggtgcagctcgcgctgcaggcggacgtcgcgcagaactacttcgaactgcgccagctcgattccgaccaggacctgtaccgccgcacggtggagttgcgcgagcaggcactgcagctcgtgcagcgccgcttcaacgaaggcgacatcagcgagctcgacgtgtcgcgcgcgaagaacgaactggccagcgcgcaggccgatgcggtcggtgtcgcgcgccggcgcgcggcatccgagcatgcgctcgcgatcctgctcggcaaggcacccgcggacttcgcgttcaaggaaacgccgatcgtgccggtcgcggtgaaggtgccgccgggcctgccgtccgcgctgctcgaacgccgtccggacgtgtcggcggccgagcgcgcgatggcggccgcgaacgcgcggatcggcctcgcgaagtcggcgtatttcccgaagctcgacatcacgggggcgttcggctatgaggcgtcgacgctcggcaacctgttcctgtggtcgagccgcacgttcctgctcgggccgttcgcgggcaccgcgctgacgctgccgctgttcgacggcgggcgccgtgcggccggcgtgcagcaggcgcgcgcgcagtacgacgagcaggtcgcgaactaccggcagcaggtgctcgtcgcgttccgcgaggtcgaggacaatctcgccgacctgcgcctgctcgacgaccagatccgcgcgcaggatgcggccgtcaatgcgtcgcggcgcgcggcgacgttgtcgcgcacgcagtatcaggaaggtgaagtcgcctatctcgacgtcatcgacagcgagcgctcggtgctgcagtcgcaactgcaggcgaaccagcttaccggtgcgcaggccgtgtcgaccgtcaacctgatccgcgcgctcggcggcggatggggcccgcgccgacggcggtcggcgatgcggcgtccgtcaaggcggaagtcgccgcgcgttgagcgcgaacggcgggcgattcgtcgctcgccggcagtgaagcgaagaaccccggcatgcaggctcaggtctgcatgccgggtttttatggcgtcacgcgttttcgctcatcgtcaggatgatcttgcctacgttcgcggccgactccatccgtcgatgagccgccgcggcatcggcgagaggaaacacgctgtcgacgaccggttcgagacccgcgcctcccgcaaagcggtccagccaatgttcgcgaaatcgccgaaccatcgcgtgtttctcgcgcgggtcgcgcgacttcatcaccgtgccgatgatttgcagatgacggtacaggatctgatcgagcgcaacgctcacgtcaccgccgccgccgagtatgccgacctgcaccagccggccgccgtttgccaatgacgcgacattccgcgaaaaatacggcgcgcccacgaagtcgatgacgacgtcgacaccgcgtttgcctgtcctgcttgcgacgacttccgaaaaatcctgcgccttgtagtcgatcgcatggtccacgccgagttgaacgatccgttccagtttcgacgcttcggcggtcgcgaatatcgtcgcgccggttgcgtaggcgagctggaccgccgcggaacccaccccgcccgccgctgcgtgaatcagcaccgaatcgccgcgttgcaagcggcccagatgcaacaatgcttcgtgcgcagtgacgaaaacttccggtatggcagccgcgtgcacgtagtcgatcgttgccggaatgggcatcgccattctccagtcgatgcgcgccagttccgcataggccccgccgcccacgacgcccattacacgatcacccaccttgtagccctgcacggcgcttcccgtctcgatcacctcgccggcgatttcgagccccatgagggtggagtcgccgaaattgggccggccgtatccgcctcgccgatgtgtcagatccgcgcgattcacgcccgcggcatgaacgcgtaccagtagatcgtcggggcgaacctcgggtgccgggacttcggccaattggagaacctcggcctcgccgaattccttgaatgtgatggctttcatttcacaccttcctgtgcgggagctgaattgccggcgagatcgtcggaccgaggttgtgcgcccagcgttgcctgcgccacggccgaagcggaaatcgctgcgggaaacccggcgtagaacgcgaggtgagtgattgccgcggagagctcttcgcgggtgacgccgttcgtcaacgcgcgccgcaggtgcgccggcaactcgtcgagatggccccctgcgatcagggcggcgacggtcacgaggctgcggtcgcgcggcgcgagcgacggatcgctccagatgcgcgggtagagcgtgtcgtcgacgaatgccgagagcgtcggcgtgaaggcccgcgcggcctcgcgcggactgtcgaaatgcgtatgagacatggcgatactccttcaagcctggctgatgaacttgtgcgtgaggtagtactcgatgccctcggtgccgccttccgagccgtggccgctttccttcatgccgccgaacggcagttcggtcgacacgatgcggtactggttgatgccgatcatcccggcttcgagaccgtccgcgacatcaatggccgtgcgcgcgctgcgcgtgaacgcataggcggagagcccgtacggcaaccggttcgcttcggcgagcccgtcggcgagggcatcgaagcgcatcagcaccgcgatcgggccgaacggttcttcatgcatcacgcgcgcgtccttcggtacgtcggcgaggaccgtgggttcgaagaaatatccttcgccctcgatgcgctttccgccggcgaggacccttgcgccacgttccaccgcatcggcgatgagttcttccatcttggcaagctggcgcggattggccagcggcccgacctgcgtgccggcatccatgccattcccgaccttgagggcctgggtggcgcgcacgaagtgcccgacgaacgcgtcgtagacttcgcgctggatcaggaagcgcgtcgacgagatgcagacctggcccgtaccgcgaaagcggttcgccgcaccgtcgaccgcggccttctcgacatccgcgtcgttgaatacgaggacgggcccgtggccgcccagctccagcgtgatgggtttgacgccttcggcggcacgcgccgacagcaggcggccgatcggtaccgagcccgtgaacgtcaccttccggatgaccggggaagcgatcagatgcttcgacacctggtcgggcacgccgaatacgacttgaagcacgcccttcggcaaaccggcgtcgtccagtgcacgtgccagcgcgagcgccgttgcggggctttcctcgccgggtttgatgatgacgctgcatccggcggcgagtgcggcggagagcttgcgcgccggggtgatcgcgggaaaattccatggcgtgaatgcagcgacgggcccgatcgcctgtttttcacgagctgttgcacgcccgggcggttggatggcaccacgcggccgtcgatacgtcgagcctcttcggcgaaccattcgaaatagtcggcggcacgcaggacttcgtcgcggctttctgccagtggtttgccttcctcaagcgtcatgacggtagcgatgtgctcggcgcgctcgcgcatcagttccgccgcacgcttcagaatgcgcgcgcgttcggcaggcacggtgttgcgccagacgtcaaaagccggtgcggtggcctgcagggcgcgatccagatcggctgccgtcgccagcgggacgcgcccgatctcgatttgcgtggcggggttgatcaccggcgccgtttcgcgttcgctcgcaccgatccattcgccgttgatgaaaagatgaagcgcgtcgtaactgatgtccatgggattagcctttatggttaggattgcgattcgatatgtgttcgccacgagccggacagggaacctgcgccacgccgtatctggacgattcgccgtggcgggccgagctcgggttcgatacttccgcgttctgattgcctgacttcgggacccagtctaggcgtgaagcgggcggcaacttagaggggccggaaagaatgaatcttgtctcgggagggaaaatctcgcaccagcgtgaaagcacattgaaaggatgcgcgaaaacgacaggggattgcgcgctgactgcacgaagcaggcgcgggccctatgatcaacaggctcgcgcgggccgaaacgcagcgattcggcgatcaattcaaaaccagggtgcgtaatggacaaggttcacaccatgtcggtgtttgcgaaggtggtcgagatgggcagtttcacggctgtcgcaaaccacctcgatacgacggtcggcaacatttcccgagcggtctcggtactcgaggacaatctcaacacgcggttgctgcagcgctcgacgcgacggctcgtcgtcaccgatgcggggcgacgtttttacgagcgcagcgttgcgatcctctcggacatcgaacgggcagaagcggaagcgcgcgatgcgctgctggagccgcgcggcgtgttgcgcgtgcatgcggtgccgggattaggccgtcaactcgtttcgcaagccgtgcttgcctatcggaacgcatacccggaggtatcggtcgatctcatgctgtcgcagcggatgccgaacctgctcgaagagcaactcgacgtggcgatcgtgattgcgcgcacgctgccggactcggcgtatgtgagccagaagatcggcgtcagccattgcattctggcggcgtcgcccgattatctggcgcatcgtccggctcccgcgtgcgtggaagacctcgtcgaccacacatgtgtgctcctgagcacggtcgattacgcgcccgacgaatggcgtctgcaaggcagggccggcgaggcggtgtatcgtccagcgggatcgcacttcagcgtcaacgacatggatgcgatgtccacggtactgcgcgagggcgcggggatcgggctgatcgccgccttctcggcaatcgacgatttgcgtaaaggatcgctcgttcgcgtgctgcctgaattccacaccgcccagcgcaacgtctatgcggtgtattcgtcccgtcagttcgtcgacgcgaagatcaaacggttcatcgatgtccttaagttgcgggtaggcgaccggttggaggcgtatgcggaggagctcgccatcacggtcgtatgacccgcctcacggccggcgtggtcgggcaggtcgagcgatgaccgaccgggaacgcgtttccggcgccgaacgcgcgcggcggtggtccagtgactgcaactaacggtcaagtcgtccggcgttgacggacggtgtggcgacgccatcgccgcaccgctcaatgcggaccgtcttcagcccgcagtgcccgcaagagttccccggcggccttgccgagcccgtatgtttcggccgccgcaaatacacaggcagcggcagcccgttgcgaatgttcgcgaacacgagcggtgcgagttcgccgtccgccacataccggtcgatgatcgattccggcaagttcgcccagccatgaccggccttcacgagcgcgatcgcggtcgccatgtcggtcaccttccacgtgcggttgccgataagcggccgcacgtcggtgagcggccgctccggatcggcgatcacgatctgccgaaaccccgacaagcgctcgatcgcctccggatgcgcggcttcggcaatcgccggatggccgggcgcggcgaccgcgatcagcgtctcggtccacagcgcgtgaatctgttcctgcggatgaagatcgagcccgccgtacgcgacgcaaagatcgacggccccgcgatgcagcgcgtcgacgatcgcatcctgcggtgcggtgacgacgctgaccgcgagcgccggatatttcgcggcgacggcggccagcgcgcgcgcaatcggcgcaccgtcgatttcggccgcgagcccgagtcgcagcgtgtcctcgacaccctccgacaagtgctgcgcatgcgcacgcagcgcatgcagccgttcggcgatcgcgcgcgcgtcgggcagcagcgcggccatcgcggcggtcggcgtcggctcgcgcgtgccgcggtcgaacagcacgaggtcgagttcggcctcgaggttcgcgatcgccatgctgatcgccgacggcgtgcggccgagcgcacgcgcggccgccgagaacgagccttcgtcgatgacggtcagcagcatgtcgatgtgatcgctggtcagcatggtcggccgcctcctgtcagaaaaattgaaaggacctgacttttacggacgaagtgtccgctgtagtctcgccaccttgttcgaaacgaaggtggtcggtcatgcaaggatggaagagacgcatagtctacgtcgtgatgttcgaggtgctcggcatcctcgtcgcgtcgtcggtgctcggcatgctgagcggcgcgagcgcggcgacgagcggcctgctcggcgtgatgatctcgacgacgggcgtcgccgtcaattttctgtacaaccttgggttcgaggcgtgggagcggcggcgcatcgaaacgacgcgcaccgtcgggcgacgtgtcgtgcatgcgatcgggtttcaggttgcgctcgtgacgtttctaattccgttgatcgcgtggtggctcgacgtgtcgttatggcaggcgttcctgtacgacgcggtgctgatcgtgtttttcccgatcttcacgttcacgtacaactgggcgttcgacagcgtgttcgggttgccggatgcggtgacgcgcaaggcggcatcggctgcgtgatgcagagggatgcgaaacgatgcggattgcctgtgccgtttcgcttccgcaagagagggaaggccgggcggcgcgcatgccgcccgctcgcgttacgcggcgacgaactcgtgcacgtaacggttgaacacggcggggcttgccgcgttcatcccgtgcgatgcgccggcgacggtctgccgttgcgcattgccgatccactgcgtcagcgtatcgacgttgttgcggaacatcttcgggctacgctggccgtcgatcagcagcgtgcggcacgcgatgtcgccggccgtgtgctgcgagtacgcgggcagcgggtcgcgcaactgcttcggcagcgtgcttgcgttgtcgatcgccatcgtgcggaaacgcgacgtgcttttcttccacgcgccgggcaggctcacggaatcgacgaacatctcgaggcccgcttcgacgtcgccttgcccgatcaggctcacggccttcgtgcgcagcgcgatcgcggcggccggcagcgcggcttcgcgcacgcccggctgttgcagcgggccgcccggatcggcgagcgtcagcgattcgacgagttgcggatgctggcgcgcgacgttgaacgcgacgctgccgccgcgcgagtggccgaccagatgcacggggccgagatcgagcgcgtcgatgaactcggcgagctcgtcgacgtggttctgccagctgaactcgtcctggatgcccgcttcgacggccggccagtaatggctgaggctcggcgcgatgcagcggtagtgcgccgacagcgacgcgagctgcggatcccagtagcggtagtcgcacagcgagccgtgcacgaacaccatcggcgcgccgctgccccgctcgacatacggcaggctgatgcctgacgaaagcgtcgcaaattgcaggtcggggttcgcgagcacggacggctcgattcgcatgttcatgactgaaagactcaaaggtgcgtcaacacgacgcaactatgcatcacggcaacctgcaaggaaaacgcataattttcatcgtgacgatcaatttttgatggctcggccgcaaacccttgtcggaaggggatgggtgccgatgctttcaatcgtctaacgattggccgtgaagccggacaggcccggaaaggcgtgtgcgacggcctgcgcacccgcgcatcgcaaccaggaaaacgggaaacgggaaggacgcgcgccgcgaacgcggccgcgtttcagcgcaccgccagcgcgggcgcggtctgaagctcgacggggaggtcgttgtcggccgcgaactgcatcgcgaagtcgaaggcgtccgcgcatatggtgcgcaattcgtcagacacgaacaggcatttgacgccgcggtcgaccaccggcatcgcgagccgcgacagcgcgcacggatagccgggccgccgctcgccgacgaacagcgtgatgacgcccgcgaggcgctcgggccagtcgctcgggcggaaggttttctgcgcgcgcgtgacgccgcggatcaggtggccggcgacgcggccgtgttcggtgatgtcgatgcgatccatgctgtcgtgcgtgtcctcgttcgcgtcattcgccgccatcggccgccgcgtcgccgcgcgcggaatccgcaggttgcgcagcttgtgatagagcgtcttcttcggcatgccgagcgcttcgctggcctccgcgacgttgccgttgtgacgctgcagcatgtcctcgatcagcatccgctcgaaatacgcgagctgctccgcgagcgtgccgcccgcggccggcgtgccgccggacgacagcaggctgtcgccggtcagcccgagcacgaagcggtccgccacgttctgcagctcgcgcacgttgccgggccatgcgtgcgtcatcagttcggatacctgcgcggccgtgacgaccggcgccggctgcccgaagcgccgtgcggccgcgagcacgaaatgctcgaacagcagcggcacgtcttcgcgccgctcgcgcagcggcggcagctcgatctgcgcgacgttgaggcgatacaaaggtcggcgcggaagcggccgtcggccgccaattcggcaagatcggccttcgacgcggcgaccacgcggcagtccaccggaatcagctcgttcgcgccgagccgctcgaccacgcgctcctgcagcacgcgcagcatcttgacctgcagcggaaccggcatcgtctcgatctcgtcgaggaacagcgtgccgccgtccgcccattcgatcttgccgatgcgcttcttgatcgcacccgtgaacgcgccggcctcgtggccgaacagttcgctttcgaagacctgctcgggcaggccgccgcagttcagcgcgacgaaatgcgcgtcgcgccggccgccgaagtcgtgcaggctgcgcgcgatcagttccttgccggtgcccgtttcgccggtgatcagcaccgacaccgacgtatcggcgaggcgcaggatcttcttgcgcacgtcggccatcgcaggcgacttgccgagcacgaacgcctcgatgccctgccagttgttcagcgccgcgcgcaggccctgcacctcgagcgtcaggcggcgcttctcgaccgcgcgcgcgacgcgcccgcgatcacgtccgacgagaacggcttctcgatgaagtcgtacgcgccgacctgcatcgcgccgacggccgtcgagatatcggcgtggccgctgatcagcacgaccgggatctgcgcgtcgatggccatcacgcgatcgagcagctgcagcccgtcgatgcccggcatccgcacgtccgacacgatcacgaccggcgcgccgggcgcgacgtgatgaagcgcgtcggcggccgacgcgaaggcatcgaccgcgaagccggcgagcgccaccgcctgctcgacgccgatccggacgttttcatcgtcctcgatgaccagcacccgaatctcatcttccatgctctgtcctttgcagcgttgccgccgcgaattcgatactgaactgcgcgccgccttcgtcgcggttcgtcgcggcgatcttcgcgccgaacgcctcgacgatgcgcgacgtgatcgcgaggccgagcccgaggccctggccgcgcggcttggtcgtgacgaacggctcgaacaggtgcggcagcacctcgggcgcgatgcccgcgccgctgtcggcgaccgtgacgcgcacacggccggcttcgtccggcccggtggcctcgatgacgatgcggcgcacgggcgcgtcgcgcaccgcgtcgagcgcgttgccgagcaggttcacgatcacctgctgcaactggctcgattcggccgacacggcggtgccgggcgcgatgtgcacgtcgagctgcacgccttcgtcgcggatccgcgcatcgtagatgagccgcgcatgtgcgacggcctcgttcagcgagaccgcgacgcgctcgacgtcgggcttgcgcgcgaaggtcttcagctcgccggtgagcacggccatgctgtcgacgagcttgccgatccgttcgagattggcgagcgccggcgccggctggccgcgctcgaagaacgtgcgtgcgttgtcgcacagcgtgcggatcgcgacgagcggctggttcagctcgtgcgtgaggccggcggccatctgcccgagcaccgcgagcttgcccgcatgcacgacttcctgctgcgacgcgcgcagccgctgctcggtgcgctcgcgctcgacgatctcgcgctgcatccgttcgttcgcggccgtcagcgcggccgtgcgctgcgcgacggtcagctcgagccggtcgttcgcgcgccgcagcgcgtcctgcgcgttcagccgcgcgacgatcgcgcggcggcgctggatcgcgtaaccggccagcagcgcggcgatcaggaacgcgccggtgacgaacacgaaggccgtctgctgctggcgccgcgcccccgcgatgtcgagcagcaccatcagcgaatcgccggcctgcggcgcggggcgcgacatcacgagatagcgtgtggtgcggccggcgtggcgcggatcgggaaaggtgccgaaccatgcggccgcgctgcggtcgccgatgcggcggtacggcagcgcgtcgaccgtgcggcccgcgtactgtcgcgacgcctggatgtcgcgctgctgctgcgcggtgatcgggcgcagcgcggtgaatttccacgcgggttcggtcgagatcacgaccacgccgttgccgtcgacgaccatcgcggcgacgcccggcgcgcgccacgccgattcgagcggatcgacgctgatcttcacggcggcgacgccgatcggcacgccgtcgtcgcgcaccgcgctcgcgaagtagacgcccggcacgccggtattggtgccgatgccgaagaagcggccgctgccgcgcgagcgcgtccttgaaatacggccggtacgacacgttggtgccgacgaagctgagcgtttcgttccagttgctggcggcgatcacgtcgccctgcaggtcgatcacgtcgaccgcgccgctgcccgcgtcgcggttcacggcttcgaggtacgtgtcgaccgtgtgcacgagctcggggcatcgtgcggcgcggctttcagcatcgcgcgcacgcggtcctgtcgcgcgaccaggccgggcaggatctcgaagcggccgagctcgctcttcaggctcgatgcatacaggtcgagccggtgcgcgccggtttcctcgagcgcgtcgatcgcgcgttcccacgcgaaatcgacggccgcggccgccacgcacacgtacagcacgccggccgatgcccagccccaccacgggattcccttgaagctcttctgcacgttcgccctcatcgaagcccgcaaccggccgcccggagcgacgccccgaacgacgcgcgccgcgcgccggcaaggccggcggcggcgcgtgcgaagcggcctgcgcgacggagcgcgcggcggcgcgtcatccgaagtgtgcgatcaggatcagcgtgaccgtgacgacgatcgcgccgccgatgcgggtcgcgatctgcgcgaacggcatcagctgcatccggttcgcggccgtgaggatcgcgacgtcgccggtgccgccttgcccgctgtggcaggcgttcacgattgcggtgtcgatagggtacatcttcatcaggcggccgaccacgaaaccggtgcccatcagcgtcgcgacggtcgacacgatcgtgaccacgttgacgatcgtgaacgcggcggtcaacttgtcccacggcgtcatcgcgacgccgatcgcgaacagcagcgggtatgtgacggcggtcgagaagaacttgtagacgacgaacgcgccttcctgcagcggcggcgacaccgcgcgcgcgagcttcacgagcaccgcgaggaacagcatcgcgaccggcgcgggcagaccgaacagcttgtgcgccatcaggccgaccaggtacagcgtgatcgccgtgatgccggcgcccgcgatgtgcgagacgtcgacgtggccgcggatttcctcgttctcgggcgtcatgtcgcccgattcgccgacctgcaggcggccgttgccggtcaggtgcgggaagcgcttgccgagcatgtcgagcgcgcccgacaggatgatcgcggtcaggctgccgagcatcaccggcggcagcaccatcgcgaacatctcgccttgcggcaggtgcatcagttccgaatagccgatcgacagcggaatcgcgccttcgccgacgccgcccgccatgatcggcacgacgatgtacagcagcgtgtggcgcgcgccgaggccgagcgcggtacccaccgccgtgccgacgatcgcggccgcgaccgagccggccgcgagcggaatgaagatcttcacgaagccctggatcagcacgcgccggtccatgctcaggatgctgccgacgatgatcgacgcgatgaacaggtacaggaagttggtcgacttcgtgaattcgaccgtcaggttcagcaccggcttcggcagcacgtggtagtacgtgagcgccgacggcacgaaggtcgcgaagatcgcggcggcgccgatgttgcgcaggagcggcaggcgcttgcccagttccgcgcaggtgaagccgaagaacgcgagcaccgcgatcgccatcgagatctcgccgggcaccttgccggtgaccgagaagccgacgatcagcgcaagcaggatgaaatagacgggcagcgggatgatgccgatgcggatttccatcagcttccaccagccttccggccagaagcgctcgcgcggggcggcgacggcgttggaaaccggctccggatgggacggggtatggatagaggtctgcaagacgtgtctcctgatgttggaatgcctgcatcgcttcgcggcatcgtgtgccgtctattacgcaaccccatgccagaaatgcagcctgacggaatatttttaatgcattgattcataagggatttatttcgtctgcggaaatgacggcccggccggctggccgagatttcgaattcgcccggcgtccaggccgagatttcggccgggcgcccggtcgggccgccgatcctgcgtggccgccgcccatatcgccgcgcgcgattttcttcgcacaatcgcttcgtagaccgtccccgctccgctctctatcatcggctgatccttttccgacgtgcttgacccttgtccggagaacgcccgcgcgttcgccgcggcgtcgctcatccgtcgataccgtctttggacaggagagtggttcccatgctgcatgccgtttttccgcccgtctttccgccggccgcgtcgcgcctgctggccgccgccctgctcggcgtcgcactgctcaacggtgcgcgggccgacaccgcgccgctgaaggtcggcatttcgacgagcccgcagatcgaggcgctgaaggttgccgccaaggaggcgaaggcgcaggggctcgacgtgcggatcgtcgaattcaccgactggaatacgccgaacgcggcgctcgcgaacaaggacatcgacgtcaactacttccagcacatcccgttcctcgagaacgcgaacaagcagggcggctacaacttcgtgtcgatcgcgcccggcacgatcatgaagatcggcctctattcgaagaaggtgaaaagcttcagcgagctgaaggacggcgcgaaggtcgcgatcgcgaacgatccggtgaacggcgggcgcgggttgctgctgctgcagcgcgcggggctcatcaagctgaagccgggcgccgactaccgcgcgacgacgcacgacatcgtgtcgaacccgaagcacctgaagatcatcccgctcgaggcatcgcaactcgcgcgttcgctcgacgacgtcgatctcgcgcagggctacccgagcttcatcaagctcgccggcacgaccgacccgaacagcgcgctgctgttcgacggcaccgagaacaagatcttcgcgatccagtgggtcgtgcggccggacagcgtgaacgatccgcgcatccgcaagttcatcgcgatctaccagcagtcgccggccgtgcgccgtgcgctcgacaacgcgttcggctcgctgtacgcgatcgcgtggtgacggaggcacgcacatgacgacggcgaaccgcaagaagatcctgctcaacgcgttcaacatgaactgcgtcgggcacatcaaccatgggctgtggacgcatccgcgcgaccgctccgcgcactacaccgatctcgactactgggccgacctcgcgaaaacgctcgaacgcggcaagttcgacgggatcttcctcgcggacatcgtcggcgtgtacgacgtgttcggcggcggccccgatgccgcgctgcgcgaatcggtgcaggtgcccgtcaacgatccgctgctgctggtgcccgcgatggcgcaggtcacgcggcatctcggcttcggcgtgaccgcgaacctgacctacgagccgccttacctgttcgcgcgccgcatgtcgacgctcgatcacctgacgaaagggcgcgtgggctggaacatcgtcaccggttatctcgacagcgccgcacgcgggatgggcctcgcgcagcagatcggccacgacgaccgctacgagcgcgcggacgactacatggacgtcgtctacaagctctgggagcagagctgggacgacgacgcggtgatccgcgatgcgcaggcgcgcgtgttcgcgcagccgggcaaggtgcggcgcgtgaagcacgacgggccgttctattcgatcgatgcgatccacctgagcgagccgtcgctgcagcgcacgccggtgctgtaccaggccggttcgtccgcgcgcggcgtcgagttcgcgggccgtcacgccgaatgcgtgttcgtgaacgggcagagcaaggccgccgcgcgtgcggcggcgctcgacatccgtgcggctgccgcgcggcagggcgcgatccggcgtcgatcaggatctttgccggcgtgagcgtcgtgacggccgagaccgaacttctcgcgcgcgagaagttcgacgaataccggcgctatgcgagccccgaagcgggcctcgcgcatttcgcgagctcgaccggcatcgacttcgcgaagtacggcctcgacgaaccgatctcgtacgtgaagaccgactcgatccagtcggccgtcgacgcgatctcgcgcaagagcacgaccggcacgtggaccgtgcggcggatgctcgaacagatgtcgctcggcggccgctatgcgccgatcgtcggctcgccgtcgcaggtcgcggacgagctgcagtcgtggatcgacgagacgggcatcgacggtttcaacctgacgcgcaccgtgatgcccgagtcgttcgaggatttcgtcgactgggtcgtgcccgagctgcagaaccgcggcgtctacaaggaagactacgatcccgcgccgacgctgcgcgagaaactgttcggcgcaggcccgcgcctgcccgcgtggcacacgggcgcgcagcaccggccggctgccgtgccggcatccgaaccagcgcatcccgcgcatgcctgaacgtgacggagcgaagcgatgacgcaattgttcgatacgctgggtttcgtcgatgcatcggccgcgcgtgccggcaccgttgccggcccgcatgacgcggcggccgcggccgccgccggtggcgctgccgtgtcgctggagcaggtcggcaaggtgttcgcgacgccgcgcggccaggccgccgcgctgcgcgacgtgacgctcgacgtgcggcgcggcgaggtgttcgggatcatcggccgcagcggcgcgggcaagtcgacgctgctgcggctcgtgaacgggctcgagcggccgagctcgggccgcgtgcgcgtgcagggcgtcgacgtcggcgcgctcgacgaggacgggctcgtcgcgctgcggcgtcgcaccggcatggtgttccagcatttcaacctgctgtccgcgaagacggtgttcgagaacgtcgcgctgccgctgaagatcgccggcgtgccgaaggccgagcgcgtgcgcaaggtcgaggcgctgctcgaactcgtcgggctcgccgcgaaacgcgacgcgtatccggccagcctgtcgggcgggcagaagcagcgcgtcggcattgcccgcgcgctcgtgcacgatcccgaggtcctgctgtgcgacgaggcgacctcggcgctcgatcccgagacgacgcagtcgatcctcgcgctgctcgccgacatcaaccgtcgcctcgggctgacgatcgtgctgatcacgcacgagatggaagtgatccgcgcggtgtgcgacacggtcgcggtgatcgaacaaggcgaagtcgtcgaaacgggccccgtgtggcgcgtgttcggcgatccgcgccacggcgcgacgcgcgcgctgctcagcacgctcgtgcacgacctgccggccgaactggccgcgcgcgtgcagccgctgcccgagcaggccgcgctgcccgacggtgcacaggtcgtgctcgacgtccgttatacgggcgagagcggcggcgagccggatgtcggcgcgctcgcggcggcgctcggcggctcggtgcgtttcctgcatggcgggatcgagcgcatccaggggcatgcgcaagggcggctcgtgatcgcggcggcgccgcgcgcggacgacgccggccagccggcggcccgcggcggtgcggtagcggcgctgctcgaacgcgcgcgccgccacgcgaatcacgcggaggtgctcggctatgtttgacctctggtggcccgaactgctcgacgcgatccgcgacacgctgtcgatggtcgccgcgtcggccgcggtcgcggcgctgctcggcgtcccgctcgcggtgatcctcgtgacgaccgcgcccggcggcatctacgagcggcgcggcgtgaacgcggtgctcggcgcgctcgtcaacgtgttccgctcgacgccgttcatcatcctgctcgtcgcgctgctgccgttcacgcgcgtgctgatcggcacgacgatcggcgtatgggcggccgtcgtgccgctgtcgatcgccgcgatcccgtttttcgcgcggatcgccgaggtgagcctgcgcgaagtcgatcgcgggctgatcgaggccgcgctcgcgatgggcgcgaagcgccgtcacatcgtctggcacgtgctgctgcccgaggcgctgcccggcatgctcggcggcttcacgatcaccgtcgtcgcgctgatcggctcgaccgcgatggcgggtgccgtcggcgcgggcgggctcggcgatctcgcgatccgctacggctatcagcgtttcgacacgaccgtcatggcgaccgtgatcgtgatcctgatcgcactcgtttcggccgtgcaaatcacgggcgaccgcctggtccgacgcgtgacccggcgtacctgagcggcgccacaagcgccggctctttcattgaagaccctgagagaacgatacccatgaccttacccatcggcgcgccgcgcgaatggaacggacaattcgaggaagcgctgttcctggacgtcgcacgacgccatcgtcccggcttcccggacaagctggcgacaccgccgcgcgagccgcgcggcgaagacgaactggccgccgtcgccgactactacacgaagatggcgtcgcacgacctgttcatcgtgcaggtcgtcgcgaaggcgatcgacacgctgttccgcgacgacccgcatttccagctgatcctgtcgcgccagctcggcgacgacggcgcgcacgcggtgatcggccgtgagcgcgtgaccgaactgacggggcgcgatccgctgccggaaatcgaccggctcgtcgccgcgcactgggcgcgcatcggcgacatcgcggtgcgcgacgtcgcgggctttctcgcgttcgagtggcattacgagctgcacatcctcgcgaagctgtggatccagcgcaagaccggccgtatcggcgacagcgcgatgcgcgagcacggcgagaaccggatccggccggacgaggagtggcatcgcgtgcagatcgtccagtggtggttcgacacgttgaaggcgctgccggcggccgaacgcgacgcgctgatcgatcgcgtgatcgcggccgacgaggaaacgcaggcgcggctcgacggttacctgcacgacgaatacgcgcacaccgcgcacgtgttcggcgcggatatcgccgaataccgcgcgatctacgacgactggcggcgcgagatcctcgcgcggttgaccggcaggcgcgaactcgggaaactcgtgccgttgtcggaagctgtctcgacccaggaacaggaagccgtcgcatgaacgatccccgcggcccggcgacgctcgccgctgcaacggatgtgtcagccgtcgatccggacgcactggcgcgcgtcatcgaaacgctgcgcgaaaccgccgccgcgcgcgatcgcgcgggcggccacgccgcgcaggaaaagcagtggctcgccgacgcgggcctgctgacgctcgcggtgccgcgcgaattcggcgggcaggaagccgggtggccggcgatctacgacacgatccggcggatcgcgcgcgtcgacagcgcgctcgcgcatctggtcgggttccagatcctgcaggtggtgagcgtcgacgtgtggggtagcgcggcacagcgcgaacgctatctgcgcggcacggtcgagcatcgctggtggtggggcaatgcggtcaacccgctcgacacgcggctggcggcgaccgcgacgccggacggcggctaccggctcgacggcgtgaagggcttctgttcgggcacgcgcggctcgcagcgcatgacggtgtccgcgcacgatccgcaagcgggccgcaccgtgttcggcgtggtgccgaccgatcgcgcggggatcacggtcaacgaagactgggacccgatcggccagcgccagaccgacagcggcagcgtgaacttcgacggcgtgacgctcgcgccggacgaggtgctgcaccgctccgaggcgccgccgacaccgcgcgcgacgctgcgcacgctcgtgtcgcagctcgtgctgacgaacctgttcgtcgggctcgcggaaggtgcgctggcggaagcgcgcgactacgtgctgaagcatggccgcccatggatacagtcggaggtcgcgcaggcgagcgacgatccgtacacgctgcagcgcttcggcgacatgcgcgtgcgggcgatcgccgcggcggcgctggccgatcgcgcggcggccgcgttgcagcgcgcgtgggcgcggcaggatgcgctgacggcggacgagcgcgccgaggtggcgctcgcggtatcggaggcgaagatcgtcgcgcagcgcgcggcgctcgacaacggcgaggcgctgttcgacgcatgcggcgcgcgcgccacggccgcgtcgctcggcctcgaccgcttctggcgcaacgcgcgtacgcatacgctgcacgatccgctcgactatcggctgcgtgacgtcggccggttcgcgttgaccgggaattgcctccggcgtcgctctatacgtgacggattgacgccggagcgggcgcggcctgctccggacaacaccctgccgatctgctggacgtccgaaatgatatgttatatcgttgcgatacaatatatcattcgttcctcaacgtcctcttccggaatcgcccgatgagcaccgccctccctccgtccacgcggcttcccgtgaccgtcctgtccggctttctcggcgccggcaagacgacgctgctcaaccacatcctgaacaatcgcgagggccggcgcgtcgcggtgatcgtcaacgacatgtccgaggtcaacatcgacgccgcgctcgttcgcgacggcggcgcagggctgtcgcgcaccgacgagaagctggtcgagatgagcaacggctgcatctgctgcacgctgcgcgaggatctgctgatcgaggtcgaccggctcgcgcgcgaagggcgcttcgaccagctcgtgatcgaatcgaccggcatctcggagccgctgccggtggccgagacgttcacgttcgaaggcgaggacggccgcagcctcggtgaagtcgcgcggctcgacacgatggtgaccgtggtcgatgcgttcaatttcctgcgcgactacgcgtcgcgcgacagcctgcagtcgcgcggcgaatcgatgggtgacgaggatgcgcgcacggtggtcgatctgctgatcgaccagatcgagttctgcgacgtgatcgtgatcaacaagatcgacctgatcgacgacagcgcacgcgagcggctggtcgcgctgctgcgcgggctgaatccgcgggcgaggatcgagatcgccgaattcggcaaggtgccgctcgagcgtgtgctcgacacgggcctgttcgatttcgacgcagcatcgcgcgcgccgggctggctgcaggagctgcgcggcacgcacacgccggaaaccgacgcatacggcatccgcagtttcgtctaccgcgcgcggcggccgttccatccgcagcgcttcttcgcgctcgtcgaaagcgaatggccgggcgtcgtccgctcgaaggggttctactggctggccacccatccgaccgtcgccggttcgtggtcgcaggccggcgcggtcgcgcggcacgggccggccggccactggtgggcggccgtgccgcccgagcgctggccgcaggacgcggaagccgtcgcgcagatccgcgcccgctgggacgagcgcgtcggcgacgcgcggcaggaactcgtgctgatcggcatggacatggacgagcccgcgctgcgcgcgcttcgacgcgtgtctgctgaccgacgccgagatggccaccggccccgaacactggaccacgtgggacaacccgtttcgcgactggccctgacctgaacgcgcttcctgcatcgatccggatggagaaggcgctccaccggatcccgagcatgaatgcccccttcccgatatctcctgaccgatgccgcgccgggccgccgcccgctcgaatgggtcggcatgcagggcatcgacctgcccgttgcggtggccgagcccggctgccggcgcgacgtgcatgcgcgcgccgacgtgcaggtcgaccttcccgcaccgcacgtgaagggcatccacatgtcgcggctgtacaggctgctcgacgggctcggcgatggcgccgcgctgtcgccggccggccttcggccggtgctgcaggcgatggtcgacagccatcgcgactgcgacacgcgccgtgcgcggctacggctgcacttcgacctgctggcgcgccgcgccgcgctggtgaccgacgggcttgccgggtggaaggcctatccggtccggatcgacgcgacgctgaccgacgtcgggttcgagctgcgcgcgcaggtgacggtcgtctattcgtcgacgtgcccgtgctcggccgcgctgtcgcggcactgggtcgaacaggcgttcctggcggcgttcggccgcgacgatcgcgtggaaccggcagcggtcgctgcgtggctgaaacggcatgcgacggcggccacgccgcacagccagcgtagcgaagccgtcgtcagcgtggggctgccggccgatggcacgacgctcgggctgatcgacctgatcgatcgcatcgagcacgcgctcggcacgccggtgcagacggccgtcaagcgcgcggacgaacaggcgttcgcggtgctgaacggcggcaacctgatgttcgtcgaggatgccgcgcgccgggtccaggccgcgctggacggccgccatgcgcacccgcgcgtgcacgtgcgccatctggaaagcctgcacccgcacgatgcggtggcctgggccgcgccggttcgcgaaggcgccgacgcatgctgatccgcaagctgttccggttcgagaacgcgcacgtggtgcgcggctgcagcacgcggcgctgctcgcattcgatccacggccattcgtatcgcgtcgagctgctgctcgaggcgcatgcgctggaccacgggcagatgatctacgacttcgggctgctcaagggcgacgtgcgcgacctgatcgacgcgttcgaccacgcggtgacgctgtggtcggacgacgatccctgttatgtcgagcatgcgccggcattccgagcgctgggtgctgctgccggtgtcgccgagcgccgagcagttctcgcgcgtgttctttcgcctcgtcgatgcggcgctgtcctgcacgcgcatgtcgaacggcgaagccggcgtgcggctgcattcgatcatcgttcacgaaaccgagaccggttacgcgcagtgttttcgcgacgatgcgttcaacccgcgcatgggccgcatcgatctggacgacatcgtgttcgcgccggccatcgccggacagtggcgcgatccgggcctgttcgagcggatcaagcgcggtcgttcgatgtcaagacaggaatcccgatgatcagaaagaacccgcgcggcgacctgccgcagatacaccgagtgcattcgtcgatccgaccgccattctgtgcgggctcgtgatcgtcgaggagaacgtgttcatcggcccgtacgcggtgatccgcgccgacgaaacggatggcgacggccggatcgcgccgatcgtgatcggtgcgcattcgaacatccaggacggcgtggtgatccattcgaagtcgggcgcgagcgtcaccatcggccagcacacgtcgatcgcgcatcgcgcgatcgtccacggccgtgcaaggtcggcaacggcgtgttcgtcggcttcaacagcgtgctgttcaactgcaccatcgacgatggctgcgtggtgcgctacaacgcggtcgtcgacggctgccacctgccgccgggcttctacgtgcgctcgaccgagcgcatcgggccggaaaccgatctcgccgcgttgccgcaggtgacggccgacgcgagcgacttctccgaggacgtcgcgcgcacgaacaatgcgctggtgctgggctacaagcacatccagaacgagttctgagccatggacgaacccgttcgacgtgaagggggcgcgaccgacgcgctgaagcgacgccatgtcgacctgctcgtgcacggcggcacggcgatgacacccaacggcgccgagcaggtcgacgtcgcgtgcgtggatggccgtgtcgtcgcgctgggtgcgttgcatggcacgtggagcgccgacgttctcctggatgccggcggcctgcatgtgctgccgggcgtcgtcgacagccaggtgcatttccgcgaaccgggcctgacgcacaaggagaccatcgaggccggcacgcgcggcgcggtgctcggcggcgtcacgacgatcttcgagatgcccaacacgcatccgctgacgctgaccgcgcaggatctgcaggccaagctggaacgcgcgcgcggccgcgcgtggtgcgactacgcgttctacatcggcggctcggccgcgaacgccgaacggttgccggcgcttgaagcgctgccgggctgcgcgggcgtgaaggtcttcatgggcagttcgttcggcgacctgctggccgacgacgaagccgtgttgcgccggatcgtgcgcaacgggcggcggcgcatggccgtgcacgcggaggacgaagcgcggctgcgcgcacgccgggcgctcgtcgaagcgagcggcgacgtgcgcgaccatccgcgctggcgcgacgtgcaaagcgcgctggaggcgacgcggcgcatcgtcgcgctggccgccgagacgggccgccggctgcatgtgctgcacgtgtccaccgccgaggaaatggcgttgctcgcgcggcaccggcagcgcgtgaccgtcgaggtcacgccgcatcacctgagcctgcatgcccccgattgctacgaacggctcggcacgtttgcgcagatgaatccgccggtgcgtgaacggcatcatcgggacgcgctgtggcaggccgttcgcgacggcgtggtcgacgtgatcggcagcgatcacgcgccgcatacgcgcgacgaaaacgccggccctatccgcagtcgccgagcgggatgaccggcgtgcagacgctgctgccgctgatgctcgatcacgtgcacgcgggccgcgtgagcctcgaacgactggtcgacctgaccagcgccgggccggcgcgcgtcttcggcatcgcgggcaaaggacgcatcgcggtgggctacgacgccgatttcagcatcgtcgacctgcgcgcgcggcggatcatccgcgacgaatggatcgccagcgtcagcggctggacgccgtacgacgggtgcgcggtcacgggctggcccgtgcatacggtcgtgcgcgggcaggtcgtggtgcgagacggcgcgctgaacgggcagccgcaggggcaggccgtcacgttcctggacgcctagatcggcaggcgaaccgtctgcttgatgcgcttcagcggaatctcggtttcgacgttgcgcacgccttcgatctgcgtgagcgtttccatctggaagcgctggtagtcgtcgagatcgcgggcgatcacgcgcagcagatagtcgtagctgccggccatcaggtggcattcgagcacttcgggcgcctgttccatctcgcgcgcgaagcgttcgaccgtcgtcttgtcctggcgctccagcgtgacgcgcacgaacgccgtgaatcgcaggtcgacggcggccgggttcagcagcgcgacatacgcgtcgatcacgccctgttcctcgagcaggtgaacgcggcgcaggcagggcgtggcggacagcccggcctgttgcgcgagttcggcattcgtctggttcgaattccgttgcaacgcacgcagaatgcgccggtcgattgcatccagtttgattgacatttctgactatccgagcggtgaatgctagagaatagcgccaaaatcggtcgtcaaagtagctgaatacgcatccaatctccatgggaaggcgccgataatccgacgacaggccgggcgattcccgtccgccggcaatcccgttcaggagctttcccatgtcgcatctatcctggctgccgttcatcgcaacgtcgctgctgatcatcgtcacgccgggccaggacatggtgctcgtgatgtcgcgtacgctgtccgacggcacgcgcgcgggcctcgtgaccgccgcgggcgtcagcgtcgggctgctcgtgcacacgatgctcgcgacgctcgggctgggcgcgctgctgcaggcgtccgaatggctgttcacggcgctgaaggtggtcggcgcgttgtacctgctgtacctcggcatcacgctgttgcgctcgtcgggcgaactgacgctcgcgagcggcgacggcgcgcaggcatcgcggctgcgcacgttcgcgcaaggcgcgctgtcgaacgtgtcgaatccgaaggtcgcgctgttctatctggcgttcctgccgcagttcgtaccggcgggcgccgcgcatccgatgctgtcgctgttcgtgctgggcgcgaccttcgcgggcctgacgtttctcgtcaaggggccggttgcggtgttcgccggcctgctgtccgcatcgatccgccgcaacccgcggatattgacgcgcatgcaccgcgtcagcgggtggtgctgctggggctcggggtgaagctggcgctcgagcgccgctgatggcggggcgctcgtgcgcgtgtcgtcgcgcgcgtgctcgcattcgaacctggcaccacgaaattcgcgtcggccgcattcgcgccttcgccgatggcgaccgcattcaccgcggaggccgtcgcgcgggcgatcgcgacgctgccggtcgcggatgccgagctgtcgatgccgagcgcaactgcatcggcagcaccagcgttggcctggatgccggcgttcgtgtgctgcttgccttcacgctccgttgtgcacgcgtcactgcgccggcaaagcgtccgccagcgcccgcattgcttccaccgtctccggattcgcggggaaaacgcctcgatcgcgagttccgacagcgtcacgtcgaccggcgtgccgaacaccgtcgtcgtgctgaagaacgtcagttcgccggccgccgtgcgcagccgcaacggcacggcgatatccgcgaagtcggtgcgcgcatgcgtgtcgtcgggctggccggccggtgccggatacgcggcgagttcgtcgcgtagcgtgtgcagcgtgcggtcgccgctcgcatcgatctgccgctgcagccgatgcaggatgtgcgcgcgccactcgtgccagttgacgatctgcgacgcgaggccgtccggatgcaggctcagccgcagcacgttgacgggcggttgcagcagcgacggatcggcctgcgcgaccagcgcgccgagcatccggttcgcggcgagcagtgtccagtgacgatccacggcgagcgccggatagggctcgtggccgcgcagcacggcttccaccgcgtggcgcgcggcatcgagctgcggatccgaaaacggccgttcgcgaaacagcggcgcgaagccggccgcgacgagcagcgcattgcgttcgcgcagcggcacgtcgagacgctccgcgagatgcagcaccatctcgcggctcggctgcgcgcggcccgattcgacgaagctcaggtggcgcgcggaaacgtccgcgtcgagcgcgagcgccatctggctcaggcgccggcgttgccgccacgtgcgcagcagcgggccgatgccggacgcgcggccggcggacggggagggcgagtggagggcggcggtcgggttcatgcagcagatgataggcaatcccgcatgccttgggcattacctgcaacgtaagcatcgcgcctcccgggcgtgtcgcggcgctgcgttaccatagccccgtgccaactgagagacgacgccggacccgcgattgaaaacgcaagggccgacgccgtgcatatttacgacaaggcattccagggaatccaacaatgaaaaacttgccgtccggctcgcctgcatggcgacgcttgcattcaccgcgatcagcggccacgcgcagaccgaagccgcgcaggtggaaatgagggccgcggcggccgccgccaacgacgcggtcgtgaagggcccgaccgacatcgacgtgaaacacgaagccgtgctgaagctgaaagccggcgaatcgttcgtgccggccgccgaagccggccgctacctgcgttcgatgggcaactcgatcgacgaaaccaagctggtcggcctcgtgctgcccgacgatcccgacgccgactggatctcggtcgtgtcgttcgagccgagcggttatatccgcgacgacgacgcgaaggactggaaacccgacgagctgctgaagagcctgcaggccggcaccgaggaagacaaccccgggcgcaaggagcgcggcctgcccgaaaccgaggtggtcggttgggcgaaggcgcccgcgtacgacgcggccacgcaccggctcgtgtggtccgcgatcatccgcgacaagggtgcggccccgaacgccgagaacgacggcgtgaactaccggacgctcgtgctcggccgcgacggctacctgtcgctgacgatggcgtcgacgctcgccgatctgccgaaatacaaggcgtcggccgacgagctgctgtcgaacatcagcttcaacgacggcaagcgctacgccgatttcaacaagtcgaccgaccacgtcgccgagtatggcctcgcggcgctgatcgtcggcgtcggcgcgaagaagctcggcctgctcgcgttgatcggcgcgttcgcggtgaagttcttcaaggtcggcgcggttgcgctgctggccggcggcgccgcgctgaaacgcttcttcgggcgcaagccgaagccggccgcggtgccggccgtcgccgatgcgtccggcatgtccgatgcatccgccacggagcgcaaggaatgacgaagctgttgctgctgatcttcggcggcctcaagctcggcaaggtgctcgtgtcggcgggcaccatgctcgcgtcgatcgcggtctatgcgctgttctacggctggcggttcgcggccggtttcgtggcactgctgctggtgcacgaggccggccactacgtggccgcgcagcggcgcgggctcgacgtcgggctgccgaccttcatcccgttcgtcggcgcgtggatccagctgaaggagatgccgcacgacgcggaaaccgaggcgtacgtcgggctcgccgggccgttcgtcggcacgctcggtgcgctggcctgctacgcggccgcgcgccactacgacagcaacctgctgctcgcgctgtcgtacacgggcttcttcctgaacctgttcaacatgattccgctgtcgccgttcgacggcgggcggatcaccgcggtgctgtcgccgcgcatctggttcgcgggcgtgcccgtgctgatcgcgctgttcgtgtatcggccgagcccgctgctgatcgtgatggcgatcctcgcgctgccgcagctcaagcgcgcgtggcgctacgatcccgacgcgccggagaatcgcgtgtactacgcgacgtcgatcgagacgaagacgacgtacgcgctctgctacgtcggcctgctcgcgttcctcgcgctgatgacgtccggcgtgtacgacatgctgcgcgtcgcgcattccgcggtctgacgcagaatcggcggccgctgttacgcggccgccgtcgtttttcttcccttttcgccgaatctcacgcgtcgcgatgctgcagctcgacgcgcctgatgtccttcacgatcacgagatagctgaacacggtgacgagcgcgttcagcccgacgaacacgagtgcgccgttgaacgagccgctcgcgccgacgaggtagccgatcgcgatcggcgcgacgatgccggccgtgttgccgaacatgttgaacaggctgcccgacaggccgatcgcttccttcggcgcggtatccgcgacgacggcccagccgagcgagccgatgcccttgccgaagaacgacacggccatcagcacgatcacgagcgcttcgctgtcgacgtagttgcagccgatgataaccatcgacagcgccatcccgccgacgatcggaatcttgcgcgcgagcgtgagcgacacgccgcggcggatcagcccgtccgacagcatcccgccgagcaccccgccgaggaacccgcagatcgcgggcagcgacgtcatgaagccggccttcagcagcgacatcccgcgcgcctgcacgaggtagatcgggaaccacgtgaggaagaaataggtgagcacgttcacgcagtactggccgagatacacgccgatcagcatccggttcgacagcagctggcgcacgtagtaccagcccgccacgcggcggccttccgagcgcaggccgtcggtgccgcgcacggacgtgcgcacgaggccgccgccctgctcgatatgctcgagttccgcgcggttcacggccggatggtcggccggatccttcacgacccgcagccacaggaacgcgagcgcgatgcccgcgaggccgagccacagatacacctggtgccagccgtacgcatgcgtgagccacgccatcagcggcgagaacaccacggccgcgaagtattgcgcggcgttgaagatcgcggacgccgtgccgcgctcggcggtcgggaaccagctcgcgacgactttcgcgttcgcgggaaaggcgggtgcctcggcgatgccgaccgcgaagcgcatcgcgaacagcgcggccaccgcgaacgcggcgctgccgccgagcccgatcgtgccctgcagcagcgtgaacgccgaccacaggaagatgctggccgcatacacgcggcgcgcgccgaagcggtcgagcagccagccgctcggcagttgcgcgagcacgtacgcccagctgaacgccgagaagatgtagcccatcgtcaccgggtcgatgccgaacgccttgcggatcggcgtgccagtgatcgacagcgtcgcgcggtccgcatagttgagcgtcgtgacgacgaacagcatcgccaggatccagtagcgcacgacggtccggcgcgcggtgcgcgcgaggtcgagcggaagatcgcgagggtggtctgattcggcactttaatgtacgtcgtcgtatgacatggtgcggagtttatgtgggttggtcgaccccggaaacctcgggttttccgttgggtatgacgcaaaacgtccaccatttgggcatgggccgaataaataagggattcgcgcattgtgtggcaagatcgacgacccgcgtgaatcgcaaaatcatgtcggcagacatcgtatctgctgggctacaatgagcccatcattcccgaaccacggagcacacccatgcaactgacaggagagatgctgatcggcgccgaagcggtcgccggctcggccggtaccttgcacgcgttcgatccgtcgaagggcgcgccgatcgacgcgccggcattcggcgtcgcggcgcaggccgacatcgagcgtgcatgcgaactcgcgcgcgacgcgttcgacacgtaccgcgcgcagccgctcgcggcccgcgcggcgtttctcgacgcgatcgcggatgaaatcgtcgcgctcggcgacgcgctgatcgagcgcgcgcacgctgaaacgggcctgcccgtcgcgcggctgcagggtgagcgcggccgcaccgtcggccagctccggctgttcgcgcgtgtcgtgcgcgacggccgcttcctcgccgcgtcgatcgatcccgcgcagcctgcccgcacgccgctgccgcgctcggacctgcggctgcagaaagtcgggctcgggcccgtcgtcgtgttcggtgcgagcaatttcccgctcgcgttctcggtggccggcggcgatacggcgtcggcgctcgcggccggctgcccggtgatcgtgaaggcgcacgaggcgcacctcggcacgtccgaactggtcggccgcgcgattcgcgccgccgtcgcgaaaaccgggatgccggccggcgtgttctcgctgctgatcggccccggccgcgtgatcggcgcggcgctcgtcggccatccggcggtccaggccgtcggcttcacggggtcgcggcagggcggcatggcgctcgtgcagatcgcgaatgcccgcccgcagccgattcccgtctacgcggaaatgagcagtatcaaccccgtcgtgctgttccctgcggcgctcgccgcgcgcggcgacgcgatcgcgacgggtttcgtcgattcgctgacgctcggcgtcggccagttctgtaccaatccgggcctcgtgctcgcgatcgacggccccgatctcgaccgcttcgaatccgtcgccgagcaggcgctcgcgaagaagccggccggcgtgatgctcacgcccgggatcgccgatgcgtatcgccacggccgcggcaagctggccgaactgccgggcgtgcgcgaaatcggcgcgggcgaggccgcgcagaccgactgccaggccggcggcgcgttgtacgaagtcggcgcgcaggcattcctggccgagccggcgttcagccacgaagtgttcggcccggcgtcgctgatcgtgcgctgccgcgatctcgacgaagtcgcgcgcgtgctcgacgcgctcgagggccagctcacggccacgctgcagatggacgccgacgacaagccgctggcccgccggctgctgccgatcctcgaacgcaaggccgggcgcctgctcgtgaacggttacccgaccggcgtcgaggtgtgtgacgcgatggtgcacggcgggccgttcccgcgacgtcgaacccgtccgtcacgtcggtcggcgcgacggcgatcgagcgtttcctgcgcccggtgtgctaccaggatttcccggacgatctgctgcccgaggggttgcaggagaagaacccgctcgcgattccgcggctgcgggacgggaaggcggagtgacgggcggcgacgattgagcgtgtgatttccggcggccagtgcgtcggggtcggtgccggcacgcggaaaccaaaaggcggatgtggccggtgggccgcgtccgcctttttgcatgacgggtttcggtgctgacgggtttgttcgaagtgtcgacaagaatcatgtcggggcagcatggaagtcggcggtcggagcagcggcctcggggtacgtgactgccgtggatcttgccgtcttccccgtccccggttttctcctacagtagcgaagcctcgggccagccggcccgcaggcaagcctgagagaccgacaaaagacaacgagggaaccccgatgaacatcaacaagcgtggcgatcacctgttcgcggccggattgtggaaagcgatcggcgacgtcgcgaaatccgtgcgcacccaggtcggccagtacagcgaagggcgcgtgctcgcgaatgcgctgctggaattccagcgcgacctgggcggcagcgaattcgacgtgacgatcaaccaggggcgcgtcgtcacgggcgccgacgcgcattcgctcgtgttcgggcaagccgtgcgccgtttccggcaggacatggaagcgctggtgttcgcgctccagtaccggcgcggcatcgacgaacgcgacccgggcctgcgcaccgaagcactgctgcaggcgaacagccagctcgcgaccgcgaagcagtcggcgacgatcacggtcggccggttcttcgatgcggtcgtcgaccgcgacgtgctcgggcagatcctcgacggcgaatcgaatgcacgcgcgcgggccgggacgcaggggcagatcgaggcgacgcgggtcaggctcgcgaacgtgcgccaccggatcgtcggaatcatcgcgcagatgtgacgcggccggccggcttgcgaggcgggttggcgtcacgcgaagcgtcgcgccggaggcggcactcgtcgcggcggatgcgggcgcggatactgctgcggacggtcgcgataccgtcgaaccggcacgcgacgcgacaaccggcctgcgcggcgccgatcaaggcgccgcgcaggccgtacccgcttactgcgggcccatcttcttgatcagcacgtcgagttcggccgcttcggcctcggtgaggtcgacgagcggcgcccgcacggggcccgcgtcgtggccgacgagcttcgcgcccgccttcacgatgctgaccgcataacccgcgcggcggttgcggatcttcaggtacggcaggaagaacgtgtcgagcaggcgaccgaccgttgcgtggtcgtccttcgcgatcgcttcgtagaactccatcgccgtcttcgggatgaagttgaacacggccgacgaatacaccggcacgccgagcgccttgtacgcggcggcatagacttcggccgtcggcaggccgccgagatacgcgaagcggtcgccgaggcggcggcggatcgtcaccatgctttcgatttcgccgacgccgtccttgaagccgatcaggttcgggcaacgatcggcgaggcgctcgagcatgtcggcgttcagcttcgaattcgcccggttgtacaccacgacgccgatcttcagtgcgcggcacacctgctcgacgtgctcggcgatcccttcctggctggcttcggtcaggtagtgcggcatcagcagcacgccgctcgcgccgaggcgctcggcctcctgtgcatattcgatcgcgacgcgcgtcgcgccgcccgcgccggcgaggatcggcaccttgcccttgcaggtttccgtcgcgacgcggatcacgtccgaatactcgcgctgcgtgagcgagaagaattcaccggtgccgccggccgcgaacagcgcgctcgcaccgtacggcgcgagccattccaggcgctcggcataggtggacgggcggaagctgccgtcggcgtcgaagtccgtcagcggaaaggacagcaggccgtgggagatgatctgtttgagttcttgcggtgaagtcatggttgggtcgtccgtctagcgcgagtgctggttcgtcgggaacggcatacgagccaaattggcgatgtcgttgtatgtcatcgtacaacgagggaaaggaccacgcaagcggtttgctggcgggtaaatgatagggtctttccggataagggtttacgcagcatcgccggccagagttgaatgtcgtatgatgactaacaatatggccgacagcctccaggatttccgatgactgcttcccctcatccgtgtgcatccggacgacaacgtcgcgatcgtcgtcaacgacggcggcctgcccgaggcgcgacgttcgccgacgggctgacgctgcgcgaaggcgtgccgcaggggcacaaggtcgcgctggtcgatctcgcggccggcgacccgatcgtccgctacaacgtggtgatcggttatgcgctggccgagctgcggcgcggcagctgggtcaacgagcgcacgatgcgcatgcccgagccgccggggctcgacaacctgccgctcgcgacgcgtgccgcgccgcctctgccgccgctcgaaggctatacgttcgagggcttccgcaatgccgacggctcggtcggcacgcgcaacatcctcgcgatcacgacgaccgtgcagtgcgtgtcgggcgtcgtcgagcatgcggtgcggcggatcaaggccgagctgctgccgcgctacccgaacgtcgacgacgtggtcgggctcgagcacacctacggctgcggcgtcgcgatcgacgcgcccgacgccgacatcccgatccgcacgctgcgcaacatcagcctgaatccgaacttcggcggcgaggtgatgaccgtgagcctcggctgcgagaagcttcagcccgagcgcctgctgccgcccggcgcgattccggtggcggccgacggcgccggcgacaacggcggtgtcgtgtgcctgcaggacgccgcgcacgtcggcttcaactcgatgatcgactcgatcatgaagatggccgaatcgcatctcgagcggctgaaccgccgccgccgcgagacgtgccccgcgtcggatctcgtcgtcggcgtgcagtgcggcggcagcgacgcgttctcggggctcaccgcgaatccggccgtcggcttcgcggcggacctgctggtgcgcgcgggcgcgacgatcatgttctccgaggtgacggaagtgcgtgacggtgtcgcgcagctcacgtcgcgtgcggcgaacgaggacgttgcgcgcgagatcattcgcgagatggactggtatgaccgttacctgcagcgcggccgcgtcgaccgcagcgcgaacacgacgcccggcaacaagaagggcggcctgtcgaacatcgtcgagaaggcgatgggctcgatcgtgaagtcgggcagcgcgccgatcgccggtgtcgtgcgtcccggcgatcgcgcgaagcagaaggggctgctttatgcggcgacgcccgcgagcgacttcatctgcggcacgctgcagctcgcggccgggatgaacctgcacgttttcacgaccggccgcggcacgccgtacggcctcgcacaggtgccggtgatcaaggtcgcgacgcgcagcgatctcgcgcgccgctggcacgacctgatggatctcgacgcggggcggatcgcgaccggcgcggcgacgatcgaggacaccggctgggaactgttccggctgatgctcgacgtcgcgagcggcaagcgccgcacgtgggccgagcagtggaagctcgcgaatgcgctgacgctgttcaatccggcgccggtgacctgacgcgcgcggccgatgccgccggacgatgcgggcgcccgacggcgcccgttttcattgcggcgcgcgtggccgcgacgggcgatcgttatgcgatgtcgatcggcagcgacagcccgaccttgacgcgcgacatcacgaccatggtttcgaagtgacgaatgttgtggtgctgccggaatacgcgcgtggaaaactcctcgtagtggtcgatgtcgcgcatcgcgatcatcagcacgaaatcggcgcgccccgtcaccacataacactgcatgacttccggcagcgacttcaggaaccgcttgaattcgtcgagcaggtcgacccgttcgcgctcgacctgcacgaggacgagcatcgtcaacgggaggccgaccttggtcggatcgacgacggaaacgtcctgctggatatagcgctcgtcgcgcagccgcttcacgcggcgcaggcatgcgggcgggctcaggccgatctcggcggcgagcgcctggttggtgatctggttgtcgtgctggaggcgggcgaggatccgcaggtcgaaatcgtcgagcggtgtggcggcgggattcatcggatttccttcggagagaaaaacgaaacaaactcgcgaatgatgccgcccgatgtttatcggatttcgcgacggctgccgataatcgtagcacccgtcaacgatgaagctgcgaggaaaacatcatgcgtttccgacatctgctgctggcgccgctcgtgctgctggtgccacttgtgtcgcttgtaccggccgttcccgcgttcggcgcggatacggtcgtcgtgggtttgccggcgcgctcacgggtgcgcaggcgcatttcggcgaggacagcgcgcgcggcattcggctcgcgatcgacgaaatcaacgcggcgcatccaggcgtcgccggccatccggtcacgttcgtactcgacgcgcaggacgaccaggccgacccgaaggtcgcgacgacggtcgcgcagcgcttcgtcgatacgcacgtcagcgccgtgatcggccaccagaattcggggacgtcgatcgccgtcgcgcggctctacgcgacggcgaacatcgcggagctgacgccgtcggccaccaatccggcgttcacgcgtctcggctatcgcaccacgttccggatgctcgcgaacgacgactttctcgggcaggcagtcgcgcgctatgcggtcgagcagttgcacgcgcgccgcatcggtgtcgtcgacgatcgcacggcctacgggcagggcatcgcggacgtgttcgccggcgggctcgggaacacgggcgccgccgtggtcgcacgcgaatacacgaccgacaaggcgttcgacttcggcgcgccgctgacgctgatcaagggccgtgcgcccgacgcgatcttcttcggcggcatggacacgcagggcgggccgatgctcaagcagatgaagaagctgcggatcgccgtgccgctgctgggcggcgacggtctgtgcacgcacgagatcctgaaactggccggcgatgcgctcgacggcaacctcgtgtgcgcggacggcggccgaagcctcgcgaagatgccgggcggccccgcgttcgcggcgcgcttcacgcggaagtacggcgccccgtgcagctctacgcaccgtacgcctacgacgcgatgatggccgtctaccacgcggtgatgctcgcgcagtccactgatccggcaaagatcgtcgacgcgctgcatcgcgtcgacttccagggcgtgaccggccggatcgcgttcgacgcgaacggcgagctgcgcaatccggcggcaacgatttcgacgttcaagggaggcaacaaggtgactttgtcggaggtagtgaaatgaatacgcggattcttccggtgggcaccgcatcgctgcgcgacgtcgcgcggccggtcggcgacgttaccgatcccgccgtacgcgaagccgccggcgcactgcgcgccgcgctgcgcgcgtttcgcgacgaacacggtttcggccgcgcggtcgccgcgccgcagatcggcgtcgggcaacggatgatcgcgctcgcgctggacggctggcccgacgtgatcgtgaaccccgaaatcgtgtggcgcagcgacgcgcggatgacgctgtgggacgactgcatgtgctttcccgacctgttcgtgcgtgtcgagcgccacgcgtcggtgagcgtgcagtacacgacgctcgacggcgagctgcatcggcgcgacgcgctgtcgcccgatgtgtcggagctgatgcagcacgagatcgaccatctcgacggcaagctgtcgttcgatcgcgcggcggggccgaatgcggtcgtgcatcgcagcgtgttcgacgccgatcgcgcgtcgtttgtcgcgcaggtcgactacgcgccgcacgcgcccgacgtgaaacgtacggcgccggagagcattcagtccgccgaagcatccgcgtatccgccaggcgccgcgtacatgaatggccgcttcgttccgatcgccgacgcgcgcgtgtcggtgctcgactggggttcctgcattccgacgtcacgtacgacaccgtgcacgtgtggaacggccgcttcttccgcctcgaccggcacatcgcgcggttcaggcgctcgctggcgaggctgcggctggacgtgccgttgggcgacgacgcgctgcgcgacatcctcgtcgaatgcgtgcgccgctcgggtctgcgcaacgcgtacgtcgaaatgctgtgcacgcgcggcgtatcgcccaccttcagccgcgacccgcgcgacgcggtgaaccagttcatcgcgttcgcggtgccgtacggctcggtcgcgaacgagcggcagttgcgcgagggcctgcacctgcatctggtcgacgacgtgcggcggattccgcccgaatcggtcgatccgcagatcaagaactaccactggctcgacctcgtcgccgggttgctgaaggggtatgacgaggggcggagtcggttgtgctgaagtgcacggacggcagcatcgccgaagggcccgggttcaacgtcttcatcgtgcgcgacggccggcttcggacgcccgagcgcggcgtgctgcacggcatcacgcggcagaccgtgttcgagctggcggcgtcgatgggcatcgacgcgcaggccggccgcgtcgacgatgcgcaactgcgcgaagcggacgaggtgttcatcacgtcgacggccggcgggatcatgcccgtcacgcggctgaacggcgcaccgatcggcgacggccggccgggcccgatgacgcgcctgctgttcgacgcgtactgggcgaagcacgaggatccggcgtggagcctggcggtcgactacgcggccggctgatcgcggcggcgcgggcgcgatttccttacctcgtacgtaatcgaccgcccgcgcgaggccggcgacgatgacggcacgcgaatacgaaacacccaacgttcgcgacctcgtccctcatcgacacaaggagcctcgccatgaacacagctcaatccgcttcgtccgcctcgtccattcacgccgacctgatcgaccgctacttcgacgcatggaacgaacccgacgtcgcgcgccgccgcgcgctgatcgacgcgaccttcacgagcgacgcggcctatcgcgatccgttgatggccggcgacggccacgcgggcatcgacgcaatgatcgcggccgtgcaggcgcgtttcccgcgttccgctttcgccgcacgaccgacgtcgacgggttcggccagcacctgcggttctcttgggcgctcgtgtcgcccgacggcgcggcgatcgtgaagggttcggacttcggcacggtcgacgcgtcgggccgcctcgcgacggtcaccggtttcatcgacgagatgccggccgcggcgccgtgacgcgagcgatgcatgcgcaacggccaccgggatcgggtaacgttatgcgattcgttcctgatcccggagactagccgacatgctgaagaatctcgacccgctgctgcacgccgacatcctgcacacgctgcgtgcgatggggcacggtgacgaaatcgcgatctgcgacgcgaatttcccggcggaatccgtcgcggagcacacggtggtcggccgcgcgttgcgcatcgacggcgccgattccgcgcgcgtcgtgcgcgcggtgctgtccgtgctgccgctcgacacgttcgttgacacacccgcatggcggatggaagtcgtcggcgacgcagccgcggtgccgcccgtgcagcgcgaggtgcaggccgagatcgaccgcgcggaagggcgcgcggtgccgctcgcgggcatcgaccgtttcgcgttctacgagcgcgcgcagcaggcctacgcggtgatcgtcaccggcgagctgcgcggctatggctgcttcatcttcaagaaaggcgtgttgttgagcgacgcgggctaaacgcgtttttcagtgcgtcgagccgccggcgcggccgccgcagtgtaaagatttgctacaacctttttcttggacacggcgaaaagaccctctatgctggcccatttgccgcgcccctcgggccgcgcggcgtcgaaccgcccggcgcgcccggggcaagcggccgaattgcatacgaggagagaggcatgacgcgtaccgtcgattccggcgtcatttttcgcacgcctggcgctggcggcgttgttcttgtggggcggcatcatgaagctgctcggctacagcgatttcatcgcgtatctgcacggaatgaacgtgccctatcaacaggtcgtcgcgccgatcgtcgtcgcgatcgaggggctgggcggcctgctgctgatcgtcggctacaaggtacggccgctcgcgctgctgatggcggtgtacacgatcgcgaccgcgatggtcgggcacaatttctgggacgcgacgagcgctgccgtccagcacgatatggtgattcacttctggaagaacgtcgcgatcgccggcgggttcctgctgctgttcgtcaccggcgccggcggcgcgagtatcgacgcgctgcgccggccgagttcgtcgtacggcgtgctgcgttgaaccgggccgactcgcgccgcgaggccgaggcaaggcaaagggccgaatcccgcacgtcgcgggattcggcccttcgttcatcaagcgggcgccggcgttcagtgcgtgcccttcacatccttcacgtccttcgcatccttcgagaactgcacggcgatcgcgccgagcacgcagatcgccgcgacgtacacgaccggcgcgagcggattcgatttcatcatcagcgacacgatcaccggcgtgaggccgccgaagatcgcatacgcgacgttgtacgagaacgagatgcccgagaagcgcacgacggccgggaagctcttgaccatcacgaacggcaccgcgccgatcgtgccgaccatgaagcccgcgattccgtagtagagcggcagcgtcgacgcatcggccgcgacctgcacgaacagcaggtagtagcacgcggccagcccgatgccgccgatgccgagcacgcgcttcgcgccgatccagcccgcgagcgaacccgcggtgatgcagccggcggtcaggcacagcgtcgcgacgctgttcgcgaacagcgtcgtcgcgggcgtcaggtggaactgcttctgcagcagcgcgggcgtcatcaggatcacgacgacgatcgcggccgacagcatccacgtgagcagcatcgacacgatcaccgcgcggccgtggtcgcgcagcacggccttcagcggaatctcggccgcgagcgccttcttcgccttcatctcggcgaacaccggcgtttcatgcagccagcggcgcaggtacacggagaacaggccgaacacgccgccgagcaggaacgggatgcgccacgcgaacgcggcgacttcggcggtagagtaacggctgttgatgccggcggcgacgagcgagccgagcaggatgccggccgtgaggcccgcggtcagcgtgccgcatgcatagccgatatgacgcgacggcacgtgctcggacacgaacacccacgcgcccggcacttcgccgccgaccgccgcgccctgcagcacgcggaacagcagcagcaacaccggcgcgaggatgccgatcgtgtcgtaggtcggcagcaggcccatcagcagcgtcggcacggacatcatcagcacgcttagcgtgaacatccgcttgcggccgaacaggtcgccgaagtgcgccatgatcacgccgccgagcggacgcgcgagatagccggccgcgaagatgccgaacgtctgcaactggcgcagccagtcgggaatgtcgtgcgggaagaacagttgcccaatcgccggcgcgaagaacacgaagatgatgaagtcgtagaactcgagggcgccgccgagtgcggcaaggccaagggtcttgtagtcgctgcgcgtgagcgcgcgttcggcggcgcgaggcacgccgctcaattcggaagcttgcatggtcaggacgatcggttttcgaatgttgttgtcggtgctgcgtctccagggcccgctatcggcatggactgacaaggcgcggcttgcatcgtcgaagcgtgtcgtgtgccgggtgaggcgcgcaacacgcgccgccgcaccgggatggggcacggcagggacgaagcgtcaaagcgggtgggaggattctacaggagcgcgaaatgcgcgcgcgggtgtgcgacgggaaggcgtcggagcgggcggccgaggccggggcaaagcgcgcgcggcgcgggcggccggtgagccgccgacgcgccgcgcggggccgggttgcgtatcagttgccggcgatcgtatcgaccggcttgaacgtgccgcgctcgaccttgtagatcgtcaccggcgcatccttcaggtcgcctttcgcgtcgtacgcgatgctcggggccgacacgcccttgaccgacaccttgccgagatacggcgtgtacaccttcgggtcggtcgagttcgcgtccttcatcgcggtgagcagcgcgatcgtgccgtcgtacgagtacggcgagtaggtgatcacgtcttcgttgaagcgggccttgtagcgtgccgcgtagccggcgaagcccggcatcttctccttcggcagcccgcccatgtagacgatcgcgccttcggccgcgtcgccgccgaccttcaggaacgtcggcgagcgcgacatctcgcccgtcacgaacgccgacttcatcccgagctggcgcatcttgcggatcatcggcgacgattgcgcgtcgccgccgccgtagaagatcgcgtccgggttcatccccttgaggttggtcaggatcgcggagaaatcgagcgccttgtcgttcgtgaagtcgcgcttgatgatcgtgccgcccgccgcctcgacggctttcgcgaattcgtcggcgatgccctggccgtaggccgtgcggtcgtcgatgatcgcgatgcgcttgaagcgcagcgtcttcaccgcgtacgtgccgacgatgcggcccgcttgcgcgtcgctcgtcagcagccggtaggtcgtcttgtagccgcgcgcggtgtattgcggcgacgtggccatcgagatctgcggcagccccgcgcgatcgtacaggtcggacgcgggaatgctcgtgcccgagttgaagtgcccgatgatcccgcggacgttgtcgtcgatcagccgctgagcgacggtcgtgcccgtgcgcgggtcggcctggtcgtcctgcgaatcgagctggaacgtgacgggcttgccgccgatcgtcggacgcgtcgcgttgaaatcggcgatcgcgagctgcacgcccttctgcatgtccgtgccgtagttcgactgcgggccggtcagcggtgcggcgaaaccgatcttgacgacgtcggcggcaatggcgtgcgcgcccgacagtgcgcaggcagcggccagcgcgacgtgcgataccttcagcttcactttcacttcccttgatggcgtggttgggccgccgccggctggcgggccggcaccggtaaaccgggcgagacggttcggtcggcaggccgatgcgagggccgtgcgtgcttgccgcgtgctgcccgggctgtgccggaatcggcgcgtgtggtggccgatgccgcaggctctgcacgccggtcgctgccgcggcggaaggtcgtctcgtgaccgtgaagcgaagtctagacagcgaaaatgcgtgcgtcttgcgcgttcggtgcgcggccggcgacgatatcggcatatcgtcgataaccctgatatatgccgaaatcgtcatgccgaatgcgcaaacgcgccaagacgctgtacggttgcatttttatgctggcgagttcgagcacgcggtgccggtgcgccggtgagcctgtgcgctcgtggcaggtcggcatcggcgcatgcggatttgcggccggccgctgcatgcgcggcgcagtggttgtgcatgcaacgtatgttgcgtgtcgaagccggtcggccgacggcgcgacgtgacggctgccgccagcttgcccgcccttgcgatcggcgcgacgcgatcggaggggcgcttctataatcgacgccatctgccactcgcattgcggttgccgggatgacgaccttgccagccgtaccgcccatgagcctgtccgatacgttgcgccaccagcccgacaacgccgatctcggcgcgatgctcgcgcatttccgcctgctcgaaccggtgttcgatgcgctgccggacgtcgcattcttcgtgaaggacgcgaacggccgctacgcgctcgtcaaccgcacgctggcgatgcgctgcggctacaaggacaagcgtgacctgctcggcaagacggccgacgaagtgtttccgcgccgcttcggccgcagctatttcgagcaggacatggcgacgatcaacgcgggccagcaactgatggaccagctcgagctgcacctgtatccgggccgccagccgggctggtgcctgacctgcaaggagccgctgcgcgatgccgcaggcagggtggtcggcctcgcgggcatctcgcgcgacctgaaggcgcacgagggatcgcacccggcgtacagccggctcgccgacgtggtccagcacatccaggatcactacgtacagccgctgaacctgaagcagctcgcgcagatggccgggatgtcggtcgcgcagctcgagcgctacttccacaaggtgttccacctgacgccgcgccaggtgctgctgaagacgcggctggatgcggccaccgcgctgctcgtcacgcacgacaaggtgaccgacgtcgcggcgctatgcggctatacggatcacagcgcgttcacgcgccagttcaggcgacggtcggcgtgacgccgacggaataccggttgatgctgcaggagcgggcggggtgacgcgacacgtcgaacgggccggcgagtcgcagggatcggggcaatacgggaaacggtgaaaaccgcggctcagcggtagccgagccctttcaggacggcggtgccgttttcggtcagccggaagctggggccgtatcggcgtcgagcttgaccatctcgacgaggccggcttcctgcagcgcaggcagttcgggtttggcgttcgcgccgatcggtgcgtgcagcagcacgagcagcgtcgcgatttcatgatgactgagcaggcggcgcagcatcgtcttctttgcagggggcggccgggcggcccgcgggtgcttctacggcgctcatcgctttcctccttttcgagataactatcgggtactggttgcggatggtgccgtcgaagacttaagcgattcttaaaactgcggccgcggaccgtatgctgcgctgcggtacgggttaccggatgtaacgtgagacgggcgcggttcccggcccgatcgcggcaagccgcgcgggcgggtgcgctgccgcgtgattcaccgcgatggtgcgcgcgggatgcggccctttgaatcggccgcggggccgcgaatgtgattcggccccgaaatccagattcgtctccttcgcttatttcctgtgctgcgcctgcgcggccaggcgcacggctgcgtttgccgccccgtagccgtcgtatccgccgcgccgctcgacgatctcgagcgagaagcggttgtcgaccagttctgtatacgcgtgcaggaattcgccgccgtgctcgtcgcggtcgtacagcaggtgatgcgtgctcagtgtgtcgatcaactcgtccggcagcgcgtagcgtgcggcgagatcgtcgtagtagttcggcggaatgcgcaggaacggaatgccgtcggccgcgaacgcggcgatcgtcttcacgatgtcgtccgtgcggaacgcgacgtggttcagccccgtgccgtggtagcggtcgagcgattcggcgaccgccgtgtgccggtcgaccgacgcgttcagcgcgatccgcaccgaaccgtcggcgctgcgcaccgcgcggctgcgcatcagcccgtacgggtcgggcacgagccagctgcgctcggcctcgaagccgaatgccgtcttgaagaacaggatccacgtatcgagtgcgtcggccggcagcgccaggcacacgtgatcgatacccgtcagcgggccgacctcgctcgggccgtcgatgtcggtcagcacgaagtccgattcatacagcgtcggcgcgttcggcgcttcgtcgacgaaatactcgaggctgccgtccggcgcctgcacactcggcagcacgcgttcgttcggcccgacgcggccggagaacggcgcatagccgaaaccggccgcgcgttcgaacgccactttcgcgtcgtcgacgcggaatgccgaagcacacagcgacaacccgtgctgctggaagaacgcatcggcgaacgagtcgcgttccgcgttcagcacgatcgacgcggcgccgtgctggaacagcgtcacgtccttcgaccgatgccggcccgcgagccggaagcgcatccggccgagccattcgccgacggttgccgcggcctgtgcgtcgaccgcgaattcgatgaactggaacccgacgtgcgcgggcggcgccggcggcgcgaacagcggctggctggcggccggcgcgcggccgtcccgcgcgagctgctcgcgtgtcagttcttccaggtagagcagcgagcgatggccgtcggcggccgtgatcgcggtcggcgccgcgcggaagccgtcgttgaagatctcgagcgacagcggccccgtgtagcccgattcgatcacgcgcgcggtgaagcgcgcgaggtcgaagtcgccctggcccgggaacgagcggaaatggcggctccattcgagtacgtccatcgcgagcttcggcgcatcggcgatctgcacgaacgcgatccggtcgccggggatgtcggcgatcgcgtccggagaatcgtcgagcgacagcgtatggaagctgtcgagcgcaaggccgaggtgcgggctgttcacggcattcacgagtttccacgcatggccgtaccgcttcacgactcggccccacgcgagcgcttcgtacgcggcgaccacgccggcttgccgcgcggcttccgcgagcgcgccgagctggtcgacgagcagcccgtcgtcggcgatcgtgtcggccgacacgttgctgcacaccaggatgcggtcggtgccgagcgcatgcatgacgtcgaacttgcgcttgatgcgatcgaggttgcgggcgagctgggctgcgctcacgccctcgaagtcacgaaacggctggaacagcacgatgtcgaggccgagatcggcggccatgcgccggacgtcggccggcgatccgtcgaagtagacgaggtcgttttcgaagatttcgacgccgtcgaagccggcggccttgatggcggcgagcttcccggcgagcgtgccggacagtgacacggtggcgatcgagcgctgcatgggcgaatcctgcggatgagcggggcacggcgccgatcgaatcgaccctgaatgaaccagtcgttgaattaacgacgaacgccatatcccgaatttactgggttagtgatacgtattgtacaaactaactaggtggtacaaattagcgaaaacccgaaagacattgcgctttcgcaagcgcacactagcgccaaatcttgacgtcaggggcgacgtcggctagcgatgcgcccccgttttaggagcagaaacaccatgagcaagcccaaggtgctggtgctgaacggcccgaacctgaatctgctggggacgcgcgagccccatatctacggcgcggaaacgctcgccgacgtcgagcagcgctgccgtacggccgctgaagcgctcgggctggaaatcgacttccgccagtcgaacgccgagcatcagctgatcgactggctgcacgccgcgcgtcacgatacgcacggcatcgtgatcaacccggctgcctatacgcatacgtcggtggcgctggccgacgcgctttccgcgatcgcgaagccggtgatcgaagttcatatctcgaacgtgcatcgtcgcgaggcgttccgtcaccattcttatgtgtcggcggttgccgaagccgtgatctgcggctgcggcaccgaaggctacgtgttcgcgctgcagcgtctggcgacgctgttcgcgcaggagccgcgcgatgagccgcccgtcgtttctgatcggcctgatcggccagggcatcggcggttcgctgtcgcccgcgatgcacgaggaagaaggtttccgccaggggttcggctatgtctaccggcggatcgacctcgacgtgctcggcgtgaccgtcgacgcactgccgcaactgctcgatgccgcgcagcggatgggctacaacggcctgaacatcacgcacccgtgcaagcagcgcgtgatcgagcacctcgacgcgctgtcggacgatgcgcgtgcgctcggcgcggtgaacaccgtgttgttcaaggacggcaagcggatcggccacaacaccgactggtcgggcttcgcgaaatcgttccgccgcgggttgcccgacgcgtcgctcgaacgcgtcgtccagctcggcgcgggcggcgcgggcgcggccgtggcgcacgccgcgctgcagatgggcgcggccgaactgacgattttcgatgtcgacggcacgcgcgccgccgccctcgcggctgaactgcagcaacgcttccccgcggcacgggttgtgcagggcggcgatctcgcggacgcgatgcgcaccgcgacgggcctgatccacgcgacgccgacaggcatggccaagcatccgggcctgccgctgccggccgagctgctccacgcgggcatgtgggtggccgacatcgtgtatttcccgctcgaaaccgaactggtccgcgccgcgcgcggccggctgcgcgacgctgccgggaggcgggatggccgtgtaccaggccgtcgatgcgttcgagatcttcaccggacgagcgccggacgacgaacggatgttcgaacactttcagtcgctggtcgcacgctgacccttctaccgactagctgaaaaagagatcaggagacaatcatgcagcacaccacccactcgaacgccgcgcccgcggcggccggcacggtccggcgcacctcggcgcgctacaagattctcgcgctgctcgcgatcggcacgatgatcaactatctcgaccgcaccgtgctggggtggctgcaccgcagctcaccaaggagctcggcatcaatgcggccgtgatgggcatcatgttctccgcgttttcgtggacgtacgtcgcgatgcaggtgcccggcggcctgttcctcgaccgcttcggcagcaagatcacctattactggtcgatgacgctgtggtcgctgtgcacgttcctgcagggcttcgtgccgggcatcgcgacgctgctcgcatgccggctcgggctcggcgtgacggaggcgccgtgcttcccgaccaacagccgggtcgtggcgacgtggttcccgcagaacgagcgcgcgatggcgaccggtacgtatacggtcggcgaatacatcggcctcgcgttcttcagcccggtgctgttcgcgctgatgggcgcgttcggctggcgctcgctgttctgggtcgtcggcgcgatcggcatcgcgttcggcctggtctggtggaagttctatcatgagccgcgcaaccatccgggcgccaactcggaggagcttgcgtatatcgaggcgggcggcggtctcgtgcacagtgcacgcaaggacggcgacaaaggcggcaagggcgcgcagaagaagttcagctgggcgatggccggcaagctgctgaagaagcgccagctcgcgggcatctgtctcggccagttcgccggcaactcgacgctggtgttcttcctgacctggttcccgacctacctcgccaccgagcgccacatgggctggctgaagatcggcttcttcgcggtgatgccgttcatcgccgcgtcggtcggcgtgatgttcggcgggatcttctccgactggctgctgcgccgcggcaagtccgcgaacctcgcacgcaagctgccgatcatcgcgggcctgctgctcgcgtcgacgatcattctcgcgaactacgtgcagagcaacgaagccgtgatcgcgatcatgtcggtcgcgttcttcgcgcagggatggccgcgctcggctggacgctcgtgtccgacatcgcgccggacggcctgctcggcgtgaccggcggcatcttcaacttcgcggcgaacctcgccggcatcatcacgccgctcgtcgtcggcttcatcgtcgcgtcgaccggctcgttcgtcggcgcgctcgtgttcatcggcgtgatcgcgctgatcggtgcgctgtcttacatcttcgtcgtcggcgacatcaagcggatcgaactgtaagcatcgcctccacgcgcatcctgtgcgttcgcccggcggccggtaggccgccgggctttgttggcgcgacgcgctgcgtgcacccttatgcgtgctgcacggcgataccgagcgattcgaccgcctgcgcgatcgccgcgaccgcgcgccggatatcgttggcgtcgatcgcaccgatgcagccgacgcggaacgtctccagctgcgtgagcttgcccgggtacaggatgaagccggcatcgcgcacggcgtcgtagaagcggcggaaatcgtaggccgggtggtcgggcgcgtggaacgtgacgatcaccggcgcctgcacgttcgcatcgaggaacggcgcgaagccgagcgcgcgcatcgattcgaccagcgtccggcagttgtccgcgtagcgcgccgcgcgccggctggccgccttcggcgagatactggtcgagcgcggcgcgcagcgcggcgatcacgtgcgtcggcggcgtgaagcgccactggcccgtcttgcgcaggtatgcgtactgatcgtggagatcgagcgccagcgacggcgaattgccttcgccggcctcgagcgcatcacgcctcacgatcgcgaaccccatccccggcacgccttcgagacatttgccgcttgccgagatcagcgcatcgatgccgctgcccgccagcgcgatcggcagcgcgccgaacgagctcatcgcgtcgacgatcagccgcttgccgtggcgtcggcacacggcggcgatgtcgtcgagcgggttcaggatgccggcgctcgtttccagatgcacctgcgcgacgtgcgtgatgcgcggctcgcgcgcgaacgcggcttcgatcgcggccggatcgacggccgcatcctcgccgaacggcaaagcgatcgcttcgataccgagccggccgaggatcttcaggatgcgcgcgcaatacgcgccgttgtcgggcaccagcacgacgccgtcgcgcggcaccagcgtaccgagcgcggcttcgaccgagaacgtgccgctgccctgcatcggtacgcacacgtactcgtcgccgccgtgcgcaatggcgacgaggtccgcgcagacgctggccgtcagttgattgaaagcggcatcccacgagccccagtcatgttgcattgcgtggcgggttgtggcggacgtggtgagcgggccgggcgtaagaagaatcggatcggacatggtttttccttgcaaaggtcggaaagaaacgccgggcggcatttctgaatggacttgcatgatattggcaaaatgtgtcatttttggaaattgtggcattcgtcacgggtttgtcatcgaacgctgtgatccttcgcttgccgcgagaaacctgacctcggcgcggcggcgaggcaggccgttgatcggccttgcccggagataacaggagagccggatcgtgccccggccatttggtgttccgcctacggagaagtgagatgacactgcagaattcctcgcgcgccgctgccggcgcgttccgcaagcttgcactggccgccgccgtcgccggtctgatgggcgccgcgttgcccgtgcatgcggcgagcgcggtcgtgctgtacacggcagacggtctcgagaacctctatcgcgatgtgctgccggcgttcgagaagaaggaaggcgtcaaggtcaacatcgtgacggcgggcagcggcgaagtcgtcaaccgcgcgaacatcgagaagaattccccgaaggccgacgtgatcgtcacgctgccgcctttcattcagcaagccggccagatgggcctgctgcaggcgtaccagagcgtgaactacaagaacgtgccgacgatcgcgaaggcggaagacggcacgtgggcgacgttcgtgaacaactacttctcgttcgcgatcaacccggacgtcgtgaagagccagccgaagacgttcgccgacctgctgtcgccggcctatgccggcaaggtcgcgtactcgaacccggccacggccggcgacgggatggccgtgctgatcctgacgacgtcgctgatgggcgaggacaaggcgttcgactacctcgcgaaactgtcgcagagcgtcaagttccacacgaagggcacgggctacctgaacgtgctgctgtcgcgtaacgagatcagcgtcgcgaacggcgacctgcagatggacctcgacgatgccgaacacggcgcgctgtccgtcaagccgatcttcctggccgcgaaggacggcgaccagccgaccacgttccagcttccgtacggcatcggcctgatcaagagcggcccgaaccaggacgccggcaagaagctgatcgactacctgatgtcgacggaagtgcagtcgaaggtgccggacatgtacggcatcccgggccgcacggacgtgccgctggcgggcaagaacggcgaagcggtcaagaaggcgatcgcgggcgtgaagctgatcccggtcgactggacccaggtgatggcgaagaagccggtatggatcgagcgctggaagaaggacgtgatcggcagctcgggcaagcagctcgacgtcgtcaagccgaagtgatcggcgcccgccgcctgtattcgtgagcaagaggatgaacccggtggaaaccaccctgacccatcccggcgcattcggcgccgccgaaccgcgagcaatgctgcggtccggcgcgccgggcggcgtgcagatcgaacacctgagcgtgcgctacggcgcgcgcacggtgctggaagatctgtcgctgtcgatcggtgccggtgaatttctgaccgtgctcggcaagagcggctgcggcaagaccacgctgctgcgcttcatcgccgggttcgtgaaggccgacggcctgaccggcacgctgaccgtcgccggacgcgacctgacctacgcgccgccgcacaagcgcaatctcggtctgctgttccagaattacgcgctgttcccgcacctgtcggtgttcgagaacgtcgccttcgggctgcgcgcgcgcggcatggcgtcggcggaagtgacgcgccgtgtcgccgatgcgctgaagcttgtgcagctcggcgacgcgggccatcacctgcccgcgcagttgtcgggcggaatgcagcagcgcgtcgcgctggcgcgcgcgctcgtgatcgagccggacgtgctgctgctcgacgagccgctgtcggcgctcgacgccaacctgcgcgcgtcggtgcgcagcgaactgaaggcgctgcacgagcgcctgccgaacctgaccgtcgtctgcgtgacccacgaccgcgacgacgcgctcgtgctgtccgaccgcgcgctgctgatgcgcgacggccacatcgcgcagctcggcacaccgcagcagctgtacgacgcgccgcgggacggctacgtcgcgcgttatctcggcccggcgaacctgctgccgccgcacgtgatctttccgctcggcgatccccgccatgaagtgcgtggcaaggtggcgtgcgtgcgccccgagcgcctgaccgtgatgccgcccgccgcgggcgggctgcacggcacggtgtcgtccgtcgaatggcagggcgcggacctgtcgatcgcggtcacgatcgatgcggcgcccgacgagcccgtgcgcgtcacgatgcaacgcggccgcggtgcggctcccgagcgcggtgcgcgcgtttccctgcattgcgaggcagacgatgtcgtccttatcgagccctgaagccggcctgccgccgcacgtgctcgcgtcggccgccgcgcacgccgccgccgcgcggcgccgcaagcgcatgggcgacctgcacctggccgcgctcgcgatcgtcgtgctgggcccgctcgtcgtctacccgctggtgcggctcgtgctgctgagtgtgtcgggcgaccacgggctgggtttcgccgcgtaccggacgttcttcggcaaccccgacacccgcaacgtgctgctgaccacgctcggcgtgctgttcgcgagcgccggcaccgcgtcggtgctcggtgtgctgctggccgcgctgctgttcttcaagccgtttccgggcgcgtcgctcgtcacgcgcttcctggagctatacgtcgcgtttccgtcgttcctcgtcgcgttcacgctgatcttcctgtacggctcgcaaggctcgatcagcattgcgctgcagcacctgtttcatctcgaaaatgcgccgctcgatttcctgttcggcatcggcggcgtgattctcgcgcagactgtgttctatacgccgttcgtcgtgcggccgacgctcgcatcgttcgcgacgctcgatttgcggctgatcgaagccgcgcgcagcctcggcgcttccggctggatgctcgcccgccgcgtcgtgctgccgatcgcgtggccgggcatcgccgccggcaccgtgctgtgcttcctgctgacgctgaacgaattcgggattctgctcgtgctcggcagcgcgcggctcgtcacgctgccggtcgcgatctacagcagcgcgaccgtcgacctcgacctgccgaccgcgtcggccggcgcggtggtgatgctcgcgttgtcgctggcgctgtatgcggtttatcgccgggtgaaccggcgcgcgacgggaggaacgatgtccgctgaattccgtatcgggcaagccgtgccgcgccgccagatcggctggggcgacacggtgctcaagcatgcgtcgcgcgcggcgctcgcgctggccgcgttcgcgtgcttctggttgttcgtgttgccggtcatcgtcgtcgcgctgtcgagcgtgtcgacgcagtggtcgggcacgatcttgccggccggttacagcctgcgctggttcgagcggctcgggtcgccggaatacgacgcgctgctgacgagcctcgaaatcggcttcggcgtgtcggcggtcggcacggtcctcgggctgtggctcgcgctcgcgctcgaagggcgcgaccggcgcggcctcggcgcggtggtcgatgccctcgtgatggtgccgaacggcgtgccgagcgtcgtgctcgggctcgcggtgctgatcgcgtatcaccagaagccggtcgacctgtcgagctcggcggcgatcgtcgtgctcgtgcagctcgcgctgatcttgccgttctgctatcgctgcgcggccgcggcgctgcgtccggagctgaccgtgctgcgcgaagcggcggcgagccttggcgcgccgcccgcgatggtgctgcgccgcgtgctgctgccgcgctggtgccggcgctgcgcgcgagcctcgcactcggcttcgcgctgtcgctcggcgagctcggtgcgacgctgacggtttatccgcccggcttcgcgaccgtgccgatcgtcgtgatcggccaggtggagcggggtattaccttccggcgtcggcgctgtcgctgctgatgctgggcgcgtcgctcgcggcgctgctgctgatcgccgcgcgcgtgccgcgcggcaagcgggcggcatcatgaacgccgcgtttgcattgcgccaacctggcgacgcgtcggcggccggcatctcgacggagcttgcgggtcgctcggtcgacgtcaacggccggcactaccggctgccggtcgagccgaccgtcgtcgtctgcgtcgacggctgcgagtacgactatctcgaacgggcggtggaagcgggtgtcgcgccgttcatcggccggatgatcgcggaaggcacggcctggcgcgccgattgcgtcgtgccgaccttcaccaacccgaacaacctgtcgatcgtctgcggcgtgccgccgtcggtccacggaatctgcggcaactatttctgggacccggccgccgacggcgggcgtggcgccgaagtcatgatgaacgacccggcctatctgcgggccggcacgctgctcgcggcggcgtccgacgccggtgcgcgggtggccgtcgtgacggcgaaggacaagctgcgccggctgctcggctggcagatgaacggcatctgcttttcggccgagaaggccgcgcaggcgaatctcgccgaaaacgggatcgtcgacgtgctcgactgggtgggcctgccgtcgccggacgtctacagcgcggcgctgtccgaattcgtgttcgcggccggcgtgcggcttgcgcagacgcgtcaggtcgacctgatgtacctgtcgaccaccgattacgtgcagcacaagtgcgcgccgggcagtgccggcgcgaacgcgttctacgcgatgatggacggttatctcgcgcagctcgacgcgctcggctgggcgatcgggctgacggccgaccacgggatgaacgcgaagcacgatcctgcgacgggccggccgaacgtcatctatctgcaggatgccttcgacgggtggtacggcgcgcaggctgcgcgcgtgatcctgccgattacggatccgtacgttgtgcaccacggcgcgctcggctcgtttgccactgtttatctggcgccgggcgtcgaccgggccgaggcgatgtggcgcgtcggcggcctcgacggcgtcgagctcgtgctcgacaacgcggaagccgcggcacgtttcgagctgccggccgaccggatcggcgatctcgtcgtgatcggccgccgcgacatgacgctcggcacgcgcgagcgcgaacacgatctgtcgggcctcacggtgccgctgcgttcgcatggcggcgtgtcggagcaggaagtaccgctgctgttcaatcgccgtatcgagccgatcgatcctgcgcgtcgcccgcgcaatttcgacgtgttcgattacgtgctgaaccgggtcgcgacatgatggctcaccccgccacgatcacccggcgtttcgcgcggaggcgctgcgctggtgcggcacgcgcgcgacgcgcgaacgcacgctcgacgtcatggacccttacacgggcacgcgcgtcggtacggtgccgctcgcgagcgtcgacgacgtgcgcgcggcattcgactacgcgatggcgtaccggccgacgctcacgcgttacgcgcgttcggagatcctcgaacgcgcggctgcgctgctgcgcgagcgtaccgaggaagcgtccgacctgatcacgctggagtcggggctgtcgaaacaggactcccgttacgagatcggccgtgtggccgacgtgttgaagttcgcggcggtcgaggcgctgcgcgacgacgcgcagagtttctcgtgcgacctgacgccccatggcaaggcgcgccgcgtgttttcgcagcggcagccgctcgacggcgtgatcgtcgcgatcacgccgttcaatcatccgatgaaccaggtggcgcacaagattgcgccggcgatcgcgaccaacaaccgcgtgatcgtgaagccgtcggagaaggtgccgctgtcggcgctctatctggccgacctgctggttgaagccggtctgccggagccgatgctgcaggtgctgaccggcgatccgcgcgagatcgcggacgagctcgtcacgcacccgcatgcgtcgctgatcaccttcacgggcggcgtggcgatcggcaaggcgattgccgcgcgggccggctaccgccgcatcgtgctggaactgggcggcaacgatccgctgatcgtcctcgacgatgccgatctcgaacgcgcggcgtcgctggcggtgctcgggtcgtaccggaattcgggccagcgttgcacggccgtcaagcggctgctggtgcagcgctcgatcgcgcccgcattcaccgaattgctcgtcgagaagacgcgtgcatggaagtacggcgatccgttcgatcccgcgaacgaaatgggcacggtgatcgacgagcaagcggcgcggctgttcgaggcacgggtcgggaggcggtcgcgcagggcgcgcggctgttgacgggcaacgtgcggcgcggcgcgctgtatgcgccgaccgtgctcgacaacgtcgatccgtcgatgacgatcgtgtgcgaggagaccttcggcccggtatcgccggtgattgcgttcgacacgatcgacgacgcgatccggatcagcaacgggacggcgttcgggctgtcgtcgggtgtctgtacggacagcacggcggcggtcgtgcggttcgtgaacgagctgaacgtcggcacggtgaatgtatgggaagtgcccggatacaggatcgagctgtcgccgttcggcgggatcaaggactcggggctcggatacaaggaaggcgttcaggaggcgatgaagagcttcacgaacctgaagacgttttcgctgccttgggagtgaatgaatggcattgacggtggaagatatccacgggctgtatcgcgagcatggccatgtggcctatagcggtgaaccggtcacgcagctcgagcatgcattgcagagcggattgctggcggaagaggcgggggctgatgaagcgctggtcgcggcggcgttcctgcacgatctcgggcatttgctgaatcgtcagggcgagacgccgagtgcgcgcgggatcgacgatctgcaccagtattacgtgctgccgttcctgcgtccgctgttttccgacgcggtgctggagccgatccggctgcacgtcgacgcaaagcgctgcctgtgccgcacggacgccggctacttcgagagtctgtcgccggactcggtgcgcagtctcgcgctgcagggcggcatcttcagtgaagaggagacggcggcgttcctgctgcgcccgttcgcggaggatgcgttgcgtctgcgccgctgggacgatacggcaaaggaagaggacaaggtgacgcctgatctcgatcactatatggcgatcgtcgcgcgccaggtgcgcgcaggctgaccggttgagttgcttctatataagacccggcacgcgacagcgtgccgggtcttatatttttgaaaaccccttgcgcagttggaagagggtgcttagaatcacgcctctttcgcgctaacggaaacgcggtgcggaagagggaagcaaagctggtggtgtgctgcagtgtcgggcgcgcggctggcctggaagttggaccccgcagtcgcaacgatgtagtgtaaaaagttgttgacgagctgcgaaacacggttcataatctcgcttctctgctgctgaaaacgcagcgctgctgagaaacacgaagttcctcgcagattgctctttaaaaattaacagccgataagtgtgggcgcttgatgaaagcgagctgatcctcggatcagatagcaaaagtatcaagagtctcacactaaagtaagtcaggtttatgaagtgattcatattcctgtcagctttgagtgagcgaccggttcttaaccgaaccgaaaacagtaacaggtttaaactgaagagtttgatcctggctcagattgaacgctggcggcatgccttacacatgcaagtcgaacggcagcacgggtgcttgcacctggtggcgagtggcgaacgggtgagtaatacatcggaacatgtcctgtagtggggatagcccggcgaaagccggattaataccgcatacgatctacggatgaaagcggggaccttcgggcctcgcgctatagggttggccgatggctgattagctagttggtggggtaaaggcctaccaaggcgacgatcagtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatccttggctctaatacagtcggggatgacggtaccggaagaataagcaccggctaactacgtgccagcagccgcggtaatacgtagggtgcaagcgttaatcggaattactgggcgtaaagcgtgcgcaggcggtttgctaagaccgatgtgaaatccccgggctcaacctgggaactgcattggtgactggcaggctagagtatggcagagggggtagaattccacgtgtagcagtgaaatgcgtagagatgtggaggaataccgatggcgaaggcagcccctgggccaatactgacgctcatgcacgaaagcgtggggagcaaacaggattagataccctggtagtccacgccctaaacgatgtcaactagttgttggggattcatttccttagtaacgtagctaacgcgtgaagttgaccgcctggggagtacggtcgcaagattaaaactcaaaggaattgacggggacccgcacaagcggtggatgatgtggattaattcgatgcaacgcgaaaaaccttacctacccttgacatggtcggaatcctgctgagaggtgggagtgctcgaaagagaaccggcgcacaggtgctgcatggctgtcgtcagctcgtgtcgtgagatgttgggttaagtcccgcaacgagcgcaacccttgtccttagttgctacgcaagagcactctaaggagactgccggtgacaaaccggaggaaggtggggatgacgtcaagtcctcatggcccttatgggtagggcttcacacgtcatacaatggtcggaacagagggttgccaacccgcgaggggagctaatcccagaaaaccgatcgtagtccggattgcactctgcaactcgagtgcatgaagctggaatcgctagtaatcgcggatcagcatgccgcggtgaatacgttcccgggtcttgtacacaccgcccgtcacaccatgggagtgggttttaccagaagtggctagtctaaccgcaaggaggacggtcaccacggtaggattcatgactggggtgaagtcgtaacaaggtagccgtatcggaaggtgcggctggatcacctcctttccagagcttctcgcaaaattgagcgctcacgcttatcggctgtaaattaaagacagactcaggggtctgtagctcagtcggttagagcaccgtcttgataaggcgggggtcgttggttcgaatccaaccagacccaccattgtctggcggtaacacctgagggtatctgtactcaatgggggcatagctcagctgggagagcacctgctttgcaagcaggggtcgtcggttcgatcccgtctgcctccaccaatcaccaacgctaagtgcttggttcatacgatgaaccgagaattttgcattggcgattgagccagtcagagcggtacgaaagtatcggctgtcgttctttaacaatctggaagaagtaagtaatttggatagcggaagcgtcttgagatggacgtgaaaactatccgggttgtgattgtatcgatgtatctcaagatgattcgaactctaagtttgactcaattggaatacggcacaacgcgagaactcaacctgtagcgactgtcgatgagacagactcgttatagggtcaagcgaacaagtgcatgtggtggatgccttggcgatcacaggcgatgaaggacgcggtagcctgcgaaaagctacggggagctggcaaacgagctttgatccgtagatgtccgaatggggaaacccactccttttggagtatccatggctgaatacataggccatgtgaagcgaacgcggtgaactgaaacatctaagtaaccgcaggaaaagaaatcaaccgagattcccaaagtagtggcgagcgaaatgggatgagccttgcactctttatttgtattgttagccgaacgctctggaaagtgcggccatagcaggtgatagccctgtaggcgaaaacagtatgaaagaactaggtgtgcgacaagtagggcgggacacgtgaaatcctgtctgaagatggggaccatcctccaaggctaaatactcgtgatcgaccgatagtgaaccagtaccgtgagggaaaggcgaaaagaaccccgggaggggagtgaaatagatcctgaaaccgcatgcatacaaacagtcggagcctcgtaaggggtgacggcgtacctttgtataatgggtcagcgacttacgttcagtagcaagcttaaccgtatagggcaggcgtagcgaaagcgagtccgaatagggcgttcagttgctgggcgtagacccgaaaccaggtgatctatccatggccaggatgaaggtgcggtaacacgtactggaggtccgaacccactaacgttgaaaagttaggggatgagctgtggataggggtgaaaggctaaacaaacctggaaatagctggttctctccgaaaactatttaggtagtgcctcgtgtctcaccttcggggtagagcactgtcatggttgggggtctattgcagattaccccgccatagcaaactccgaataccgaagagtgcaatcacgggagacagacatcgggtgctaacgtccggtgtcaagagggaaacaacccagaccgccagctaaggtccccaaatatagctaagtgggaaacgaagtgggaaggctaaaacagtcaggaggttggcttagaagcagccaccctttaaagaaagcgtaatagctcactgatcgagtcgtcctgcgcggaagatgtaacggggctaagctatataccgaagctgcggatgcgtgcttgcacgcatggtaggagagcgttccgtaagcctgcgaaggtgccttgtaaagggtgctggaggtatcggaagtgcgaatgctgacatgagtagcgataaaggggtgaaaggccccctcgccgtaagcccaaggtttcctacgcaacgttcatcggcgtagggtgagtcggcccctaaggcgaggcagaaatgcgtagctgatgggaagcaggtcaatattcctgcaccattgttagatgcgatgggggacggatcgcggaaggttgtccgggtgttggaagtcccggtcgctgcattggagaaggcacttaggcaaatccgggtgcgtaattcaagggtgtggcgcgagcttcttcggaagcgaagcaattggaagtggttccaagaaaagcctctaagcttcagtctaacgatgaccgtaccgcaaaccgacacaggtgggcgagatgagtattctaaggcgcttgagagaactcgggagaaggaactcggcaaattggtaccgtaacttcgggataaggtacgcccttgtagcttgactggcctgcgccaggagggtgaagggttgcaataaactggtggctgcgactgtttaataaaaacacagcactctgcaaacacgaaagtggacgtatagggtgtgacgcctgcccggtgccggaagattaaatgatggggtgcaagctcttgattgaagtcccggtaaacggcggccgtaactataacggtcctaaggtagcgaaattccttgtcgggtaagttccgacctgcacgaatggcgtaacgatggccacactgtctcctcccgagactcagcgaagttgaagtgtttgtgatgatgcaatctacccgcggctagacggaaagaccccatgaacctttactgtagctttgcattggactttgaaccgatctgtgtaggataggtgggaggctatgaaaccggaacgctagtttcggtggagccgtccttgaaataccaccctggtttgtttgaggttctaaccttggcccgtgatccgggtcggggacagtgcatggtaggcagtttgactggggcggtctcctcccaaagcgtaacggaggagtacgaaggtacgctaggtacggtcggaaatcgtgctgatagtgcaatggcataagcgtgcttaactgcgagaccgacaagtcgagcaggtgcgaaagcaggtcatagtgatccggtggttctgtatggaagggccatcgctcaacggataaaaggtactctggggataacaggctgataccgcccaagagttcatatcgacggcggtgtttggcacctcgatgtcggctcatctcatcctggggctgtagccggtcccaagggtatggctgttcgccatttaaagaggtacgtgagctgggtttaaaacgtcgtgagacagtttggtccctatctgccgtgggcgttggatatttgaaggggctgctcctagtacgagaggaccggagtggacgaacctctggtgtaccggttgtcacgccagtggcatcgccgggtagctatgttcggaagagataaccgctgaaagcatctaagcgggaaactcgccttaagatgagatatccctggggactagatccccttgaagggtcgttcgagaccaggacgttgataggtcaggtgtgtaagcgcagtaatgcgttcagctaactgatactaattgcccgtaaggcttgatcctataacaagtctgccttgtagatcggcgccgtgcgacagcaccggccgcaagatccagagcgacaagttggattctcgtgtgtgatacacacaactcaaaattactgcttcttccaagattggttctgttggccatgccagcaggacaaccctctttgcctgatgaccatagcgagtcggtcccaccccttcccatcccgaacaggaccgtgaaacgactctacgccgatgatagtgcggattcccgtgtgaaagtaggtaatcgtcaggctcctaagccagaaaccccgcccaaaaggcggggtttttgcattccagcgacggaaatgcacggcacaggccaagcaatactgtggccggagccgagaccgccgacagtcgtggatcaggatctgccatccccgagcaatccgccgccaagcatcgttgatatcctcggtacgttctctgcggaccacgccgatccaccttcagtcagcgtccggtcgatgtcgatacattcagtggcgatgttttgatgatcgacgatgcgcgacgttcgtcgaagatggtcgataaatgtcgccttctggcaaaattccctgcttcatccgccggtctttcgacgagccctgtcgacctgatcggcgtgcacccttctgcgaacgcaccacgaaatcgtaataaaaatctatgcgcataaagtccgttcgcacggcatgcgctgcagagcggggagcaggcccttcggggtaatatcgccattcgtcccgattcccagtgctttcaggcgtccgctggcggtcggtatcctccgtattccgtctctcgcacagttcatgactgacagccctgcccaaggtagtcggacgaccgacttcttgccgtatctcgtcgccgcaacgttcttcatggagtacctcgacacgaccgtgatcgcgaccgcattgccgcaaatggcgcgttcgttcggtgtcggtccgaacgcgctgagcctcgggatgaccgcctatatgctcgcgttggcggtgttcatcccgatcagcggctggatcgcggaccgctatggatcgcgtacggtattcgcgagtgcgattgtcgtctttaccggtgcgtcggtgctgtgcgggctgtccgaaggtgtcgtgacgttcacggctgcacggctgctgcagggcgtcggcggggcgatgatggtgccggtcggacggatgatcgtcgtgcgcagcaccgagaaggcgaagctgatgcgagcgatcgcgacgatcacgtggccgggcatcgtcgcgccggtcgtcgggccgccgatcggcggcttcatcacgacctatgcgtcgtggcgctggatcttcctgctgaacgtcccgttcggtattgccgcgctcgtctgtacctggctgatcgtccggaacacgcgggctgacgagcaacggccgctcgactgggctggattcgtgctggccggtggtgcattgacttgtctgttgatcggtaccgaagcggccggccagcaggacgtcgacttcacgcgcgcgggcgtcctggtgggggcgagcgtgctgttcggcacggccgcgtggtggcatgcgcgacgctgcgcgcatccgctgctcgacttcaccacgctgaaggtgccgaccttctcggtgacggtgatctccggctcgatcacgcggatggcgatcaacgccgtgccgtacctgctgccgctgttgttccagatcggcttcgggttgtcgccgttccagtccggcctgttgctgctcgcgagtgcgctcggcaatctggggatgaaggcgggaacgtcgtggattctcgaccgatatggtttccggcgcgttgcgctcgtcgacgtgacaattgtcggcatcttcacgattgcgtgcggctggctgaccgcgtcgacgccgctggcaatcacgctgctcgtcgtattcgtctacgggctcacgcggtcgatgcagttcacgacgctcgcgacactcgcctatgcggatatcccggctcatcagacgagtgcagccagcacgctgtggagtgccgcacagcagatgacgatcggaatggggatcgcgttcggtgcattgtcgctgcggctcgcggcgttggtgcgcggcgatgcggttggcatgcattacgtgctcgacgatttccgctgggcattcgtcgcggccggcgtgctcgcgctgctgacgttgccgggttatgcgcggctggcttccgatgcaggcgatcggctgcgggcgagtgtggcgcgagggtaggtcgagcggcgcatccaatttgcaccgcgataggtgagcgcgactgtttttcgtcgctcacccgaaacgtcgatccgttgtggtggttgcgatggcctgactgtcagcgcagtcggccctttgtccctgctgcgggcgtgggggcagtagcgtagcggggtgctccccgcgtgaaccagaaatcatccgcgtgacgaacgtcgggacgacaccacgctcgtcctcgctgccgtcactgcgcgtcatgaaagatgatgccgaccgtgtggcggtggccactgcgaatccggctcacgccgtggcgcaggttgacgcgatagacgccgcgcgtcccctgcacgggtctgccatgcacggcgaagatcaccgcgtcgccttgcatcagcggcaccacttccgcccgtgattgcatgcgtggccgctgttccgtcaacacgaattccccgcccgtgaaatcgcggcccggcgccgacagcaggatcgcgacctgcagcggaaacacgtgctcgccataaagatcctgatggagacagttgtagtcgtcgggaccgtattgcaggatcagcggcgtcggtcgcgtctgccccgccgcccggcagcgatcgaggaatgtcgtgtggtcgttcggatagcggacgtcgattccgagtgcctggttccagcgattcgcgatgggtgcgagatgcggatagatcgtcgcgcgaagctcggcaatgaccgcgggcagcgggtacgcgaagtacttgtattcgccgcggccgaatccgtgccgcgccatcacgacgcgcgaacgataaagcgcatcccgtggatagagcgacgcgagcgcatcgcattcgttcgtcgaaatcaggcccggcacacgcgcgcatccatagcgatcgagctcggcgccgacagtcggccagtcgatggcgtcgatgcgttgtgcgatgtccggcgattcgacggcaggttgcagatcggcgatgttcacgggcgtcccttggttcgtcagcgatgtggcgccgagtcgtgcggaatgcccggaagcattgcgtgcacggttggagccacgaagaaagtcgatgaacccagtctagcgacgttcgtttgccgatgcgctccagatcttgcgcttcaatccggaagcaagagggaatggcagggacgcgcacggacacatcgaaggcggcgacgtatcagtgcggagaggcggagaggcggagaagcggagaagcggagaagcggagaagcggagaagcggagaagcggagaagcggagaagcggagaagcggagaagcggagaagcggagaagcggagaagcggagaagcggagaagcggagaagcgaagaagcgagcggcgaatcttccacgacaggcggccggctcacaccggccgcccgtcgcaacgtgaatcaagccatcgaccggaacaaccagtagagcccgccggcaagcgcgatcgacgccggcagcgtcagcacccacgcgagcacgaggctgcgcaccgtgctccactgcagcccggagccgttcgccgccatcgtccccgcgacacccgacgacagcacgtgtgtcgtcgacacgggcaatccgtacacgtcggcggcgccgatcgtcagcatcgcgacgagttcggccgatgcgccttgtccgtacgtcagatgctgcttgccgattttctcgccgacggtcacgacgatccgcttccagccgaccatcgtgccgaggctcagcgcgatcgcgacggcaaccttcacccacgtcggaatgaatttggtcgcgtggtcgagctgcttgtgatagttgtcgatcgccagcttgtcgtcggccgcgaacgcgggctgacccgacttctcgatcaggcggattgcttcggataccagatacatcgtgttgcgcacgttgtcgacgtcgcgctgcggcacggctgccatcgagcccgacgtgccgaccgcggtcgcgagcgacgtcgacagctgctggacggccggcagcacggcgggcgtcagttcgcgatgctgcacgtagcgctcgacgtcggcacgcgggttcgcggacggcgcgacgccgttcgtgtacttcccgaacgtcgcggccgcctggttcgcgaccgccacgaaggtctgcgtctcggccggcgtgacggccttgttcagcgcataggcggtcggcaccgtgccgatcaggatcagcatgatgagccccatccctttctgcccgtcgttcgaaccgtgcgcaaacgacacgcccgtgcaggtcaggatcagcaggcagcgaatccagaacggcggcggctggtctttcggcggctccttgtacaactccggaacccgcacgagcgtcttcagcacgagcagcagcagcgctgcgcacagaaagccgacgatcggcgagaacagcagcgacttgccgacaccgagcgcctggccccagtcgacgccgctcgtgccggacggcccgtgcatcagctggttcatcagccctacgccgatgatcgaaccgatcagcgtatgcgaactcgacgacggcaatccgaaataccaggtcgcgaggttccacacgatggcggcgatcagcagcgcgaacaccatcgcgaagcccgcgccgctgccgacctgcaggatcagctcgaccggcagcaactgcaggatgccgaacgcaacggcaccgctcgagaccatcacgccgaggaagttccacatgccggaccagatcactgcgacgttcggcgtcagcgagtgcgtatagatcacggtggcgaccgcgttcgcggtgtcgtggaagccgttgacgaattcgaagccgagcgcgatcagcagcgccgcgccgagcagcaggtacgggaacagcttgccttcgcggatcggcgacagatcgtcgatcaggtgcgtggcgatatagagcgcgccgagcgccagcaccagcaggaagacggcatagccgacctgtctggtgcgttcgacggagcccgggttgttcggtgcggacgaagcaggttgattcatgacgccatctcgtgagggaaccgcgtccgatcctatctgcggccagcagtcagtttgatgacagtcgggaccacgaacggcgtgtcttgccgatgtgtaaggcgattgaaggcgtgtatgcgcgacgtgacgtgccagcccgcatcgtcgtccacatagtgagcgcaatggcgctctacgcgttgccgtccgcgctcaacgtccatccgttcggtgacgcaacaagcgtcgtgcaggacagcggcgcgacgtcgatgcgggcggctgccttcgaatccatccgccgcacatgggcgatggccgcgcggacgattggcgcatgcgtgattgcgacgatgtcgcgatcttgccgcagcccgttcaaccatgtgccgacgcggtgcatggcggcttcgaacgattcaccgccgtgcggcgacgccgacgggtctgcgatccacgcatccagttcgtccggcaagtcgcgtgcgaggtcgtgcaggcgctggcctcgccagttgccgtaatcgatgtcgcgcagtgcgtcgtcgatgtcgacatgaagtccgagcgcatcggcggtctgccgcgcgcagcatgcggggctgcacagcaggagcgcgccggcggtacctgcccaccggccgcgtagcgcagcggcttcggcgatcccgcgtgtatcgagcggatcgtcgtcgggaaacgcgccggtgcgcatcgcccgggtcgatgcgtgtgcgatcaggcgcagcgaggtaggcatgttcatgtcggttttcggatgatccgggacgggcgctcgtgtccgcttgacaccgcttcaatacgcgaacgttcgcgcgtacaattcgcccgatacgaagcgcggaagccggtgcaagcccggcgcggtcgcgccactgtaaccggtgatcgatgatcccggaagccagacctgccttcgtacccatccaacatttgtcggggcgcgattcccctgaggtgcatccatgagcgaagcagtgctgaagccggcggtcgtgccggcgcccatccccgtccgtgaactgttgccgtgggccgtgttcgtcggcctgatcctgttgctcgcgctttatttcgtcggcgcggaacaaggtgcgacgtcgctcgtgccgggcatgtacgtccacgaattcgtccacgacggccgccacctgctcggcttccctgccactgacgcggagttcacgatggtcggaaagctgctcatgcgcgggatgctcgcaggcatcgccgcaggcctcctcacgttcggtttcgcgaaggtcgtcggcgaaccgcaagtcgatcaggcaatctcctttgaagaaaaaccgacgccgccaagggcgatgcaccggagccggagctggtcagccgccacacgcaggccggcctcggcttgctgacgggcgtcgtgacctatggcgcggcattcggcgggctgttctcgctggtcttcgcgtatgcctacgggcgaggcagccgcctcccggcccgtccgctggccgcgtggctcgcgctggcggcgttcatcgcgctcgtgatcgtgccgaacctcaagtacccggccaatccgccgtcggtcggcgaccccgacacgatcggctatcgcacgggcctgttcttcctgatgatcgcgatctccgtcgcgacgatggtgttctcggtcagcgtgcgccgccatctgctggcgaagctcggccagtggaacgcgtcgatcgtcgccgggctcgtgttcgtcgcgatcatcgcggccgtgcagatcgggttgccgtctgtcagcgagttgccggccgatttcccggcggccttgctgtggaagttccgcgtggcggccatcggcatgcaggtgatcatgtggacgacgatcggcctgctgttcggcgcatgggtcgagcgcggcgagcgcatcggcatgcgcgccgtctgacgcgcacggcaacggggcacgcctagcgcagcatgcgtggcgcgctcccgtcgattcgcgcgccagcgcgacgaacgcggccagatagtcgatcgatgcgtccgcttcgcggatgccgaggaagatctgcttcgcgatccccttcttgccgagcttgaccggcacgaccggcatccggtcggcgtattcgtcggcaagccatctcggcagcgcggccacgccgcgctcgctcgccaccatctgcagcatgatgtcggtcgtctcgatcgacttgtgccgcctcggcacgatgccggccggcgtcaggaactggttgtagatgtcgagccggtcggtttcgaccgggtaggtgatcaggatctcgtcggtcagctgttcgggcgtcacgtaatcggcgttcgcgaaccggtgcgaatcggcgaccaccagcacctgctcgtagtcgaacacggggtcgaagcgcagccccggcttgttcagcggatcgggcgtcacgagcacgtcgatgtcatagccgaacagggcgccgatgccgccgaactggaagcgctgcttcacgtccacgtcgacgtcgggccagcgcgacaggtaaggcgacacgaccttcagcagccactggtagcacgggtggcactccatcccgatgcgcagcgtgccgcgctcgcccttcgcgtactgcttcatccgctcctcggcgagctcgaactgcggcagcagccggttcgccagcttcagcagatactgcccgccctgggtgagccgcaggccgcggccctcccgatcccagatcggcgtgccgagctgctgctcgattttccggacggtgtggctgagtgccgattgcgtgaggtgcagcgcgtgggcggccgcggtcagtgagccctggcgctcgacttcacggatcacgacgagatggaatcgttccagcatggatatcgctcgtgcaacggatacatgaacagatttaatggatgaatgaaataatgccattttatttcatgggatgaaatccctatgatggctgccggatcttcacttcttctggacggcagctcatggtcacgacacacaacctcggttttccgcgcatcggtgcgaagcgcgaactcaagttcggtctcgaacgctactggaagggcgaatcgtcgcgcgacgagctgaaggcgctcggcgccgagctgcgcaagcgtcactggaacgaccagcgcgacctggacctggccccgatcggcgacttcgcgttctacgatcaggtgctcgacatgagcttcacgctcggcaacctgccgaagcgcgtgcagggtttccacggcgatgtgctcgacaactatttccgcgtcgcgcgcggccgttcggcgcagtcggcggacgagcatgcggcgtgctgcggtggggtctccgccggtgaaatgacgaagtggttcgatacgaactaccactacatcgtgccggaattccacgcggacacgaacttctcgctcgacccgtcgcgcctgctccagcaactggcggaagcgcaggcgcagggcgtggccgcgaagccggtcatcctcggccccgtcacgtacctgtggctcggcaaggcgaaggacgattccgaccgcctcgcgctgctgccgaagctgctgcccgtgtacggcgcgctgctcgacacgctgaccgcgcagggcgtcgaatgggtgcagatcgacgaaccgattctcgtcactgaactcgacgccgagtggcgtcaggcattgcgcaccgcctatgcggcgctggaaacgcgtcgcatcaagctgctgctcgccacctacttcggccagcttcaggacaacctggcgctcgcgagttcgctgccggtcgacggcctgcatgtcgatgcgatcaacgcacgcgacgaggtcgacgcgctggtgcgtgaactgccggccgggcgcgtgctgtcggttggcgcgatcaacgggcgcaacatctggaagacggacctgaacgcgacgctcgactggctcgaaccgctcgcgaagcaactgggcgatcgcctgtggctcgccccgtcgtgctcgctgctgcacgtgccggtcgatctcgcgagcgaggagaagctcgatgcggaaatccgctcgtggctcgcgttcgcgctgcaaagctcgacgagctgaaggtgctcgcgaccgcgctgaacgaaggccgcgacaaggtggccgatgcactggccgcgaacgctgccgcgatccattcgcgccgccactcgccgcgcgtgcacaacccggcggtaaaggccgcgatcgccggcatcgacgcgcagctcggcaaccgcgtgagctcctacacgcagcgtgcgtcgaagcagtcggcacgcctgaagctgccggcgtttccgacgacgacgatcggctcgttcccgcagaccggcgaaatccgtcacgcgcgcagccagttcaaggccggtgcgctggacgatgcgggctaccgggccgcgatgcaggctgaaatcgaacgcagcgtgcgcgagcaggaagcactggaactcgacgtgctggtgcacggcgaagccgagcgcaacgacatggtcgaatacttcggcgagcagctcgacggctacgcgttcagccagttcggctgggtgcagtcgtacggctcgcgctgcgtgaagccgccgatcctgttcggcgacatcagccgcccgaaggcgatgacggtcgaatggatcacgtatgcgcagtcgctgacgaacaagccgatgaagggcatgctgaccggccccgtgacgatcctgaactggtcgttcgtgcgcgacgaccagccgcgctcggtgtcgtgctaccagctcgcgctggcgatccgcgaggaagtgctcgatctcgagaaggccggcgtgcgcgtgatccagatcgacgaggccgccctgcgcgaagggctgccgctgcgccgcgcgcaatggggcgcgtacctgaagtgggcggtcgagtcgttccgcatcaccgcgaacggcgtgcaggacgacacgcagatccatacgcacatgtgctattcggagttcaacgacatcatcgcgtcgatcgccgacatggatgcggacgtgatcacgatcgagacctcgcgctcggacatggagctgctcgacgcgttcgacgacttcaagtatccgaacgagatcgggccgggcgtgtacgacattcactcgccgaacatcccgacgcaggaacacatcgtcggcctgatgaggaaggcggcggaacggattccggcggagcgtctgtgggtcaatccggactgcgggctgaagacgcgccagtgggcggaagtgattccggcgctgacgaacatggtcgctgccgcgaagacgctgcgcagccaggtgcaataacgcagcgagcgctgcacgccgccgtttcgatcgaagatcggacggaaaaacggcccgcggaagcgggccgttttgcgtcatgcgagcacttgcgttatgccgtgcgtgcgccgcgcggcagcggctcgttcgtcttgccgggcgcgccggcatcgtcgatgctgacgcggcgcgagatcagccacacgcacagcgacgacaggagcgcggcgctcgtgtactggagcgcgagcggccaccattgcggcgcggtgttctgcgcaatgatggtcgcgacgagcggcgtgaggccgccggcgagcgcgccgcacacctggtacgcgatcgagatcgccgtgtagcggatgcgtgcgacgaagatgccgctgacgaagcccgcgaccaccgagtagtagcccgattccgcgagcgtcgcgaggccgacgccgaccgtgatcgacagcggcgtgcccatgtgcacgagcggcagcatcacgaacgggacgatcgcggcccatgcgccggtgatcagcagcacgcgcgtggtgccgaagcgctgcgcgaggaacgcggccgcgagctgcacgacgaactgcagcaccgcgacgatcgtcatgcaatgcagcaccatcgaccggtcgagcgacaggaactgcgtcgcgtagctgatcatgaagatgttgctgaaatacacgccggcgatgccgtacacgttcgcgccgatcgcgagcagcagcagcggccagtacttgagcgcttcacgtagcggtttttgcgcgatgttgccgctcttcctgacttcctcgaactcgggcgattcggacacgctcgcgcggatcacgaagccgacgatcagcagcacggaactcgcgaggaacggcacgcgccagccccagctcatcatgtcttccttcgacagcgtgctgatcgcgccgaacgcgagcatcgacaggatcaggccgctcgcgctgccgagctgcgcgaacgacgcgaagaacgtgcgtttgccttccggcgcatgctcgccggcgagcagcaccgcgccgccccattcgccgccgactgcgatgccttgcagcacccgcatcagcacgagcaggaccggtgcaatcacaccggcctgcgcatgggtcggcagcaggccgatcgcgaccgtcgacaccgccatcagcatcagcgtcgcgagcagcgagcgcttgcggccgaagcggtcgccgagatagccgaacatcacgccgccgagcggccgtgcgaagaagcccaccgcgaacgagccgaacgatgcgaggaggctgatgaagcggttttcgccgggaaagaacagcggcccgaacacgatggcggcggcggtcgcgtagctatagaagtcgtaccactcgatcgtggtgccgacgaacgacgcgagcgcggcccgtttgggttgcttgacggaagtccccatcttgatatgtgctcctctggaatcctttgattttggaataggggtggcgcgggagtcagtcgcggtacttgacgcccggcagcacgcacagcagctcgtatgcgaggttcgcgccgagcagcgccgtggtgccgaacgggtcgtacggcggcgcgacttcgacgagatcgcaaccgacgatgttcagccccttcgcgccgcggatgatctcgagcgcctgcggcaccgtgaggcccgcgatttccggcgtgccagtgcccggcgcgtaggccgggtcgatgccgtcgatgtcgaagctgatgtagacgggcgtatcgccgacgcgcgcgcgcttcttccatcagcggcgcgagcgacttgttccagcattcctcggcctggacgacgcggaagccctgctcgcggcaccagtcgaaatcctcggccgcgtagccggtgccgcgcaggccgatctgcgtgaccttgtcgccgtgcagcaggccttcctcgaccgcgcggcggaacggcgtgccgtgcgcgatcttttcgcccatcatcgtgtcgttcacgtcggcgtgtgcatcgacgtggatcaatgcaaccttgccgtgcttgcggtggatcgcgcgcaggatcggcagcgcgatcgtgtggtcgccgcccagcgtgatcggcttgcagtcatgctcgaggatcgcgtcgtacgcggcttcgatgcgcgcgatggaatcgtgcaggttgtacggattgatcgcgacgtcgccgatgtcggcgatctgcagcgaatcgaacggcgcggcgcgcgtggccatgttgtacgggcgcagcagcacggattcggtgcggatctggcgcgggccgaagcgtgcgccggtgcggttggaggtgccgaggtcgaacggcacgccgacgaagcaggcgtcgaggccttcggcgctcgccacgtgcggcaggcgcatcatcgtcgcgatgccgccgcagcgcggcatttcattgccgccgagcggctggaaatgggtgtggtcgttcatgggctgtctcttccgatgtggggttgccgtatcatgcgacgcggcctggcgcacagttttacgcgctccgccgggaaagaagaatgcgaagatatcgacgtaaacatcgattttcatcgatgtatggaagggatgaacgtgctggggaatctgtcgaccctcgatctgcggttgatccgcgtgtttctcgcggtcacggacgcgggcggcgtgtcggccgcgcaggccgtgctgaacgtcgggcagtcgacgatcagcgcgcagctttcatcgctggagacgcggctcggctaccggctctgcgagcgcggccgtagcggtttccggctcacgccgaagggcgagcggttccatgcgatgagccgcaagctgctcgcggcgctcgacgaattcgggatggccgcgcggcacatggaccgccagctggtcggcacgctgcacatcggcctgatcggccatacgccggtgagccagaacgcgcggatcgccgaggcgatcgccgcgttccgcacgcgcgacgaggccgtgcgcttctcgatctccgtgcgcgcgccgggcgatctcgaggagaagctgctgagcgacgagatccagatcgcggtcggctacttctggcaccgggtgccgtcgctgcactacacgccgctgttcatcgagcgccaggtcgcgtactgcgggcgtggccatccgctgttcgacggcgcgggcgcgctgacgccggccgacgtcgcgggtttcgaatgggcgtggcgctcgtatccgctgcccgaagcgcagatgtcgacgacgcccgaccgcgtgaccgcgacggccgacaacatggaggccgtcgcgctgctgatcctgtccggccaccacctcggctacctgccgcagcatttcgcggcgccctacgtcgcgcagggctgctcgcgccgctcaatccggagcaactgcgctacgacgtcacgttccacatggtcgtcgcccgcaacgggcgcggcaatccgctcgtggaagcgtttctcgaggatctggaacgcgcgcaccagccgaccgacatcgcgtagccggccggcatcgacaatgtgaacgagtgttgcggcggcgcgatccggcgcggcccacatcgacgggtgtcgaagtgacgaaacgggtgtcgggtccggcttgcgtgaaccgtgcacgcgccggcatcacggcaccggcagccccgcgtcgtgcttgacctcgcgcagcgacagcgccgattcgatcgacgtcacgcccggcagcatccgcagcgattcgcgcaggaacgtgccgtaatcgtcgagatcgcgtgccacgacctgcagcagataatcggcggtgcccgccacgttgtggcacgccaggatccgctcgatgccgagcacttcccgttcgaagcggtcggcggtcttgcggtcgtgcgtcgcgaaccgcacgagcacgaacgcaacaacgccgtagccgagcgcctggcgcgacagctgcgcgcggtatcgctcgatgtagccgtcgttttcgaggcgcttcaggcggcgcgcgcaaggggtctcggagaggcccacggtgtcggcgaggcgggcgatcggcaggcggccgtcgcgctgcaccgcggcaaggatggcgcggtcggttttgtcgagttcggtcatgatggcggattcctgatgcggattcgacgattgtggcggattcccctacggatcgccaatcctgagccaaagatggccaataatccctcgcgctccagcggcaacatatcgccgtaagaggagaggggcagaccatgatttccacgcatttgctgttgatttatctcgccgcgctggcggccatctacgcggtgccggggccggacatggcgctcgtgctgcagaccagcatcggccgcggcgtgcggccgggaatggcggccgccgcgggcctgtcgctcgcgcgcaccgcgcacgtgacgctgtccgcctgcggtgtcgcggcgctgatccgcagcgcgccgtggctgtacgaagtgatccgctacggcggcgcgctgtatctcgcgtatgtcgcgatccaggtgttccgttcgcccgtgttcgcgctcggcgacggcgacgcggcggccacggcgggcgagttgcgtcagtcgttcgtgaagggcctgctcaccaacctgctgaacccgaaggcgctgttgttctgctcggtgctgctgccgcagttcgtgcgccccgaggccgggccggtggtgttgcagatgttcgaactgggcgcgctgctggtggcggccggcgtgtgcttcgacctcgcgtgcgtgttcggcgcgtcgcggatcgccgcgtggatgcgtgcgcatccgctcgcgcagacggtgcagcgctggacgttttccgcggcgctgatcggctttgcgctgcgcctgtcgatggactgagtggcgccgcggcgtcgcgccggcgcaggtcgcgcggcgcgtcgccgcatccgatgagggccgcgcgcaatgccggcccgcgcgtgcgcccgccgcagaagggcgtgcgcgcaaatcgtctgactgatctaaactccctgttacttcgcgctgtcgcgaacccgaacgaccgaacggaaccgtctcccgccggccctgtccgatttcctggctgttccgtgcaacgcggtaccaaggagggtctgaacatggcaaggcatcttcacgccgaccgtgaaccccgaatcgtcgccgagtccaagtgcctcgggccgtgcgatccggcagaacgcatccacgtcacgatcatgttgcggcggcaggaagaagggcaactcgatacgctgcttcaccagctcgccaccggcgacgcgcaagcgaaaccggtgtcgcgcgaaaccttcgcgcaacgtttttccgccaatcccgacgacattcgcaaggccgaggacttcgcgcgtcgccatcagctgacggtcgatcgcgtcgatccggtcgaaagcgtcgtcgtggtgtccggcacgatccagcagttcgaagccgcgttcggcgtcaagctcgagcgcttcgagcatcggtcgatcggccagtatcgcggccgctccggcccgatcgcgctgcccgacgatctcggcgacgccgtcacggccgtgctcggcctcgacagccgtccgcaggcgcggccgcacttccgcctgaggccgccgttcacgcccgcgcgcggcgggcgggcgtcacgttcaccccggtccagctcgcatcgctgtacggcttcccggccggcgacggcgccgggcagtgcatcgcgatcatcgagctcggcggcggctatcgcgcggcggacatccagcagtatttccgcgggctcggcatcacgaagccgccgacgctcgtcgacgtcaacgtcggcaccggccgcaacacgccgaccggcgatccgagcggcccggacggtgaagtcgcgctcgacatcgagatcgccggcgcaatcgcgccggccgcgaagatcgccgtctatttcgcgccgaacagcgacgcgggcttcatccaggccgtcaacgcggccgtcagcgacaggaccaacaagccgtcggtgatctcgatcagctggggcggcccggaggcgatctggcaggcgcagtccgcgcaggcgttcaaccgcgtgctgcaggcggcggccgcgcagggcatcacggtgtgcgcggcctccggcgacagcggctcgggcgacgggttgcaggacggcgccgatcatgtcgacttcccgcatcgagcccgtatgtgctcggctgcggcggcacgcagctcgacgcgctgcccgggcagggcattcgcagcgaggtcacgtggaacgacgaggcggccggcggcggcgcgggcgggggcggcgtcagcacgctgttcgacctgccggtgtggcagcaggggcttgccgcgacgctggccgacggcagccgcgtgccgctcgcgaagcgcggcgtgccggacgtcgccggcgatgcatcgccgcagaccggctacgaagtgtcgatcgcgggcacggccacggtgatgggcggcacgagtgcggtcgcgccgctgtgggccgcgctgatcgcgcggatcaacgcggcggcgagtgcggcggctagtgcggctggcggtgcgtccgccggctgggtcaatccggtgctctacaggaatccgggagcgctgcgcgacatcacgcacggctcgaacgggacctacgcggccgcgcagggctgggatgcctgcacgggcctcggcagcccgaacggcgcgcagctcgccgcgatcctgacgcgcaagccgtcgagctgacggccgcggtacacgtctttccgcatggcgcgggcttcctgcccgcgccttttctcacctccaggagcagcacgatgggcatcgattccgcatcttccggcggcgtgtatccgctgcatcacggcgaccacaattcgcatggcgtgccgccgaccgtcaacccggtcgcgttgagccacggccgtgaccagccgttcttcgatccggtcgcgtacggcaacggccccgacgattcggtgaccgacaccaccgaggcggccgcgatcacgcatcacacgattctgatcgacgggaagcgcatcgcctacacggcgacggccggccatctcgtgacggtcgacccgagcagttcgctgccggccgcgaagctcttctacgtcgcgttcacggccgacggcgcgaaggaagaaacgcggcccgtgacgttcttctacaacggcgggcccggctcgtcgtcggtgttcgtgctgctgggctcgttcgcgccgaagcgcatcaagacgtcgatgccggggttcacgccgcccgcgccgtaccagatggaagacaacccggacagcatgatcgaccacagcgacctggtgttcatcaacccggtcggcaccggctattcggcggccgtcgcgccgaacaagaaccgcaacttctggggcgtcgaccaggatgcggattcgctgaagcagttcatcaagcgctacctgacgaagaacaaccgctggaattcgccgaaatacctgttcggcgaatcgtacggcaccgcgcgcagctgcgtgctcgcgtacaagctgcacgaggacggcgtcgacctgaacggcgtcacgctgcaatcgtcgatcctcgactaccggcaggccggcaacccggtcggcgcgctgccgaccgcggcggccgatgcgtggtatcacaagaagctcggcgtcacgccggcgccgaccgatctcggcgcgttcgtcgaggaagtcgcgcagttcgcgcgcaccgactacctgaacgcgttgcgcacggtcccgcatgcgaacccggccgccgtgcagaagctgtcgcaatacacgggcatcgatacggcgacgctgcaatcgtggagcctcgacatcgccggctacgacgcgcgcggcaattcgctgttcctgacgacgctgctgcatgcgcaggggctcgcgctcggctcgtacgacggccgcgtgaccgggatctcgtcgggcatcgccggcaagatcgacccgaactcgggcggcaacgatccgacgatgacggccgtgacgggcgtctatacggcgatgtggaacagctacctgaacgagcagctgaagttcacgtcgaattccgcgttcaccgacctgaacgaccaggcgttccagaactgggatttcagccacatcgatccgaccggcgcgcagcagggtatcgatgcgcaggggaacgtgatcctctatacggccggcgatctcgccgcggtgatggcgctgaacgtcgacctgaaggtgctgtcggcgaacggtttctacgatttcgtcacgccgttctaccagaccgtgatcgacctgcagcagatgccgctcgaggatcagaaggtgcggcagaacctgtccgcgcgtttttatccgtcggggcacatggtgtatctcgacggcggctcgcgtaccgcgctcaagcgcgatctcgcggcgatgtacgacgcgacggtcagcgacacgggggcgcggatgcggattcgcgcgctgcaggcgtcgaagacgggcgggcacgcatagggttgcccgccgccgggttgccgcgcgtagccgtcacggccgcgcgcggcggttgggctccgacgctgccggccggtcgccgggccccgcagcgcaggatggcgacgcggcagtcgttgcgccgcggtcgcgacttacgcggccggccagtcgaacggcgtgtacggcagcgcgcgcttgtggcgcgaagcgtcgaagaagcgcagcaccgtttcgtacacgcggtcttcgaccggcttgccttcgaggaaatcgtcgatctcgtcgtaggtcacgccgtacgcgtgctcgtcgggccgcagcgggcgcagctctcgagatcggccgtcggcaccttcatcacgatcagctcctcgccgccgagcgcacgcgcgaccgcgcggacgcgccgcttgctcaggcccgcgagcggcaggatgtccgcgccgccgtcgccgaacttcgtgaagaaacccatcagcgattcggccgcatggtcggtaccgatcacgatgccgcgccgtgcgccggccaccgcatactgcgcgatcatgcgctcgcgcgccttgatgttgccgtgcacgaaatcctgctgcgccggcgtgtcgaatgcgtggccggaggcgaccagcgagcggagcatcgcgtcggcggccggcttcacgtcgaccgtcagcacctcgtccgcgcgcacgaacgcgagcgcgcgctgggcatcggcttcgtcgttctgcacgccgttcggcaagcgcatcgcgatgaagcgcgcatcgtagtcgtcggcgcgcaggcgctcgaccgccagttgcgcgagccggccggccgtcgacgaatcgacgccgccgctgatgccgagcacgtaggtccgcaggccggtcgaacgaagatattgcgcgaggaaatcgatgcggcggtcgatctcggcctcggcgtcgaagtgcggggcaacgttcagttcggcaatgatcgcgcgctggcggctggcgtaatcggcggatgtcatgaaggaagttccggaacgaaatgcaaggcgcccatcataagcgcaatcgcggcgcggtgccgcgccgggcgtgcgttccggcggttttgcgttgcatcggcgagacgggctgcatcgccgtggtgcacggtgcgccgggcgggtgcagcgtgacgcgtgacgggcatccctgcgcccggcgccgacgcgggtaccggcccggcggcgcgcgtcagcgccgcgcgagtacgacgcccaccagcgcgagcgcgaagccggcgagctggatcgccgcgagcgtttcgccgaacagccagtagccttgcagcgcggccagcggcggcgcgaggaacagcagcgacgtcgcgcgcgcggcgttgccgcggcgcagcatccacatcagcatcgtgaccgcgccgccggacaggaacacgacgccccacaccagcgacacccacaacgccggcgcgccgagccagcgggtttcgtgaagcagcgcgacgaagacggccgcgacgatcgccgcaccgaaattctgcacggcaaccgccgtgcgcaggtcgctttgcgcgagcttgcccttctggtacagcgagccggcggtgatcgacccgaccgcgagcaccgagacggcgacgacgagccacgcaggcgcggcgcccggcgccggcgcgacaccgtccgtcaccttcggcgccagcacgagcgcgacgccggcgagcccgagcgccatcccgagccaaccgcgtgcgggcaggcgctcgttgaacagcggcacggcgagcacggcggtggcgagcggctgcagtgcgccgagcagcgccatgacgcctgcgttcagcccttgcgcgacggcccagtagctcgcgccgagatagacgccctgcagcagcgcgcccgatcaggtggcgcggccattcgcgccgggccggccacggcgcgcgcgcgacgagtgccaccgcgccgaacagcgcggccgtgcccgcgaaacgtgcgagcaggaacaggttgggatcggcgtagggcttgatggcccgcgcaacgatgaagccggtggaccagagtgcgacgaaagcggcggcgacgagcgaggtcagcatgcatggcgggccgcgatgcggccggacagaatcgtgaagtcggccagtatcggggaagcgatgccggcgtcttgtcgaatcctgcactcatgctgcgtgccgaatgtgcaccacgtgcggccatcggtgcgggccgggcggtgccgcgggaacgggatgggcgccgcccggcatgcgcagcgggcgggcgtgaagcagcggagatcagtcgatcgagaacgtgtcgagcggctggttggcgcgggcgtcggtcgcgaagcgcgcggcgagctgttcgtagagccggcgggcctcgtcgagcgtcaggtcgatccagtacggatcgccggccgcgtcgttgagtcgttcgggcggaaactggatttcgatcacactgcctttgcgatacatggcgtgagcccctttgcttggtctgtcgttctgcgaagcgcaaagtgtagcaaccggcgccgcgccgattcgcgcgcgtcgggcaatacagaatttcgctttcgggaaacgcggcccgcccggcgtcccgccgccgtcaaatgccggtcaaacggccgtaatacaatgggcggcttacccattaccagtcgcctcgggcgcacacgcgatgctggcggaacaacgtcatcaattcatcctgtcggagctcggacggtcgggcgcattgtcggtcgcggaactcgtccgctcgctcgacgtgtcgcgcgagaccgtgcggcgcgacctgaacgcactggccgcacgcggcctgctcgtgatgacgcacggcggcgcgctggccgcggatcgccgtgagccgagcctgtcggagcgcgaagccgcgaatgccgaagcgaagcgcacgatcgggcggcgcgcagccgagttcgtgcccgacgatgcctcggtgctgatcgattcgggcagcacgccgcatgcggttgcgctcgcgctcgccgaccggcaccggctgtcgatctacacgaacgactggcgcaccgcgttcgtgctcgcgcgacgcaacggcaatcgcgtgacgctgctcggcggcgagctgtccgacgacgaggacgccaccttcgggctcgacacgatccagcagctcgcgcagtaccacgtcgatttcgcgttcatcggcgccggcggcatcacgcccgacggcgaattcaccgactactcgcggctcgcggccgaggtgcgcagccggatgatcgcggcggccggcacggcgatgatcgtcgccgatcattcgaaattcggccgcgtgacgccggtgcggatcaacggcacggccgccgcccgctatctcgtcaccgagcgcgcgcccgacaaggccgtgcgccgcgcgctgaccgcgcgcgggatcgagctgctcgtgtgcgactgacgcacgccggacatacaaggttcatcgaaccgtcattccgcgggaagaaccgccgtcaagactgactcattcacctcgaccggccgccaggccagggagcaacgaatgaccgtcagcgtgcgcagctatctttccccactctggtcctgctggccttcgactggcccgatgcggcgtcgcgcgccgatttcctcggtttcgcgatccggcgcacgccgggcttctggtcggccgacggcaagacgcgcgcgccggacagctggctgccgaaccgcctgatgttcgacggcccggccgcgcacacgcagggcgacgcgccgaccgaccaggcgccgatccagaaattcatgtggtgggacgcacgcatcgatccgcaggatcgcggtgcatcgtttcgctacgacgtgtatccggtcgtcggcacgccggcgaatctgcaggtactcgacgcgcaagccggcgtgtgcgacgtcgtgctgcccgcgcatgtcgaggacggcatcggcacgtggttcaaccgcgcggtggtcagttcgcaggctttcgcgaagcaggtggcggcgctgggcctcgcgccgaatgcggcgccgagcgacgcgcaggcgctgaagctgcgcacctggctcgcgaacgacatggagcaggtgttcgcagagatgctcgatccggcatcgcgcgcggcgtcggccgtctatcacctgaccgacacgctgtgggcgctgcccgcgttcgaagcgttcgggcgcacccacggcgaagcgtcgctcgcgatcgtctacgacgcgcacacgacggcgcgcaagggcaagccgccgctaccgtcgccgaaccagccggccgtcgatgcgctgcagggctcgcgacgctcgcgccgcgggaccggacgcacatcatgcacgacaagttcatcgtgaccgatgcggcgtcgaacccggcgcccgcgcgcgtgctgaccggttccgcgaacttcacgaccgagggctcacggagcaggcgaacgtgctgcacgcgttcgattcgcccgagcttgccgcgctctacaacgcgcgtgcgcatgcgctggccgggaatccgccgatcgcggcgaccgcgcggctgtcgccgggctggtcggaaccgatgacgatcggcagcgcgcaggtgcggctcgcgttttcgccggaaccggcggggcagcgcaccgagatcgacacgatcgtcgccgcgatcgcggccgcgaagcattcggtgtcgttctgcctgttcatgccgaccgacgcggcgctgcgcgacgcgtgcttcgcggccggcgaccgcgggctgatgatgttcgggctggtgaacaggatcaacgccggcagcgcgacgaaggccgatgccgcgcggcaggccggccggacgctcgatgcggcgacgctcgcgaacctcgagctgtatcaccgcagccgcgacaaccgcgacgtgatcgatgccgcgtatttctcgccggccaccgtgccgcagggtttcgagcccgagctgcgcctcttcccgggcgagccggcgccggcctttccgccggtcgtgatccatcacaagttcatcgtgatcgatgcggaaggcgcgaatccggtcgtctatacgggctcggcgaacatgagccgcaattccgagcagtacaacgacgagaacctgctcgagatccgcgacaagcggatcgcggcgatctatctcgcggaattcctgaggctttacgagcactatcgtgcacgggcgctggcgatcgatgcgaagcagccgcacggcacgggcaccggtacgggcgcgcatgcgcggctcgcgcttgcgcccgattcgagctgggcgaagaagtactacgtggcgggaagcccggaagagaaggcgcggatcgcactggcgtcggccgcgccgacggactgacctgagagagggcgacgggcgcggatgtcgcgcgcccggtgtgaggccggccgggaaaccggccgtcgtcgtcgcttatgcggcgacgtagcgcagcacggcgtcggcgatcgtgtcgcgatgccgggcgcgcaggcgcggcgccgacgggtcgcgtccgaacgcggcgccgaacgtgtagcggttcgacacgcggtggaagcagaacgagctgatcagcaggtgcaggtcgaatgcgtcgatgtccttgcggaacgcgccgctcgccgcgccgcgctcgaccagttcctcgagcgtcttgatgatgctgacgttgcggttcttgaacgacttgagctgttcgagatacttcgcgccgtggatgttctcgatcgacacgaggcggacgaagtcgcgatgcttgtcgtgatagtcgaacgtgaattcgacgaggcggcgcatgccttcgcgcggctccatgtcgccgacgtgcagttcctgctcgagtgcgcggatgtcgccgtacaccttctccagcacggcctcgtacaggccttccttgctttcgaagtagtagtagagcatccgcttcgtcgtgttggtacgctcggcgattgcatcgacgcgcgcgccggcgagccccatcgcggagaattcctgcgtggcgacatcgaggatgttgcgcttggtttgctcgggatcgtatttgcgccgcgcatcggacggaagcgtgcgggtatcggacgtggcggccttgcttcctgctttcatgtgactttattgtggcttcggcggcgtggaaaaggcattctagcatgcggaaatccccgcccggccgaccttccgctctaatcggcagggcggttccggccgccgcggccgctcagcggcggcaggacgcgagcgcgtcgcgggcctggtacgccgtgtacgtgagctgcgcggccgcgaggcccgccagcccgaacgtgcgcgtgagcccgaacgcgttgaagccttccggtaccggccggccttcggccagtgcggccgcgagcgcttcgccggcgaccgtggtcggcgccatcccgtggccgccgaacgcgatcgcgtgccacacgccgtccgcgtcgcggccgatctgcggcatcttgtgccgcgcgtagctcatcagcccgccccacgcgtagtcgaccttcacgtcttccagttgcggatacacgcgcagcaggtcgcgccgcagcaggcgggcgatcgcatcggggccgcggtcgagcacggagatccggccgccccacaggatgcgcgtgtccttcagcgggcggtaatagtcgaatgcgaaacgcgtgtcgtaaatcgcgtacggtgcgtcgatcgcgtcgggcaggcgcgtgccgagcggctcggtcgcgatcacgtaggtcgcgatcggcagcaccgcgcgctcgatgcgcggcgacacgccgcgtgcatagccgccgccggcgaacacgacgtccttcgcgcgcaccgtgccctgtgcggtgcgcacgacgtacccggcgccttcgcgcgcgatgccgagcgcggccgagcgttcgtacacgcgcgcgccgccgcgcgatgcggccgccgcgacgccgagcacgtacttgagcggatggaagtggaacgcgttcggttcgaacaggccgccgtaatagcgctgcgtcttcagccgcttgcgcagcgcggccgtcgaaacgggttcccagtcgacgccgagttcgtccttcatcagcgtgcgcacgctgtcgagcctcgaaggatcgtcgaaccagttcgcgagcatcacgccctggtcgacgatgtcgcagtcgatgccgtagcgcgcgatccgcgcgcggatcaggtcgactgcatcgacggtgagccggtacagccggcgccctcgtcgcggccgagcgtgcgcaacaggtcggcgttgtcgaggctgtagccgccgaagacgaagccgccattgcggcccgatgcgccgaagccgacccgttcgctgtcgagcacgacgacgtcatgcacgccgcgctcgacgaggccgagcgccgtgcacaggccggcgaggccgccgccgacgatgcagacctgcgtgtcgatcgtgccggtcagttgcgggtagggctggcgggtaacggtggcttcgtagaagttctgcatgcgatttcgttgactcgtaacggcggaaaaacaggcggcgcgcgtcgatcttgcctgaacgcgcgcgccgcgtcgaatggggcgcggggcaccggccgtcgcgactgggcggcggccggtgcgaagtgggcgggtgcgggccgatgcgggccgactcgcgcggtcaggtgcccggtgtcgggttggccggacgggcgatgtagcccgcgtagccggtttcggcctgcggcgcggtttcgggtgtcgcgttgcgttcgatccacggcgcgatttccatgtcttcgtagcgcacgaggcggcatttgcgcacgagtgcgtagccgagccagatcgcgaggaagaacggcaggccgatgtaggtcgcggcgacgcccacccagtcgatcttgtcggagaggaacgcctgataatcctggccgagcgcgacgaccgcgcacaacgcgaatgcgaacagcgggccgaacgggaaccacttcgaccggtacggcagctggtcgagccggtagccctgcttcaggaaccccttgcggaaccggtagtggctgaccgcgatgccgagccacgtgatgaagccggccatgcccgacgtgttcagcagccacaggtagaccgtcttgtcgccatacagcgacgtgaggaaacacagcgcgccgacggccgtcgtcgcgtacagcgcgttgcgcggcacgccgccgcgcgacagcttcgcgaagatcttcggcgcgcggccttcgaccgcgaggttgtagagcatccgcgtcgacgcgtacatgcccgagttgccggccgacagcacggccgtcaggatcaccgcgttcatcacgccggccgcgaacgcgaggcccgcgtggcggaacacgagcgtgaacgggctcacgccgatgtcggtcacgtcgctcttcagcaggttcgggtcggtatagggaatcagcacgccgatcacgaagatcgcgaacacgtagaacagcaggatgcgccagaagatctgcttcaccgcgcgcgggatcgtcgtgcgcgggttttccgattcgccggccgcgacgccgatcatttcggtgccctggaacgagaagcccgcgatcatcgcgacgccgagcatcgtcgcccagccgccggcgaacggcgcgtcgccgatcgtgaagttgccccagcccgcgctcgggccgccctgcatgatcccgaagatcatcagcaggccgacgccgacgaacgcgagcaccgtcagcaccttgatcagcgcgaaccagtattcggcttcgccgaagccgcgcaccgacagcgcgttgagcgcgaagatcaacgtcaggaacagcgcgctccaccagacgcccggcacgtgcgggaaccagtaatgcatcacgagctgcgcggcgacgagttccaccgccagcgtcacggcccagctgtaccagtagttccagccgagcgcgaagccgaagccttcgtcgacgaacttcgcgccgtaggtcgcgaacgagcccgacaccggcatgaacgcggccatttcgccgaggctcgtcatcaggaaatagaccatcaggccgatcaccatgtacgcgagcatcgcgccgccggggccggcctgcgagatcgacgcgccggacgcgacgaacaggcccgtgccgatcgagccgccgatcgcgatcatccgcagatggcgtgcctgcagcgcacggtggagggacggcttcgcgggcggcgagccggacggacggggtgaatcggggcgggcatctgaatgcatggcgggcgctgggcgctgtctccggattatttttcggtgacgaagcgcgacgcgttgccggctgcgggccgggcagcggtgatgcggtgcgaaagcgcgccggtgagccggggcgcgatgcgtgtcgccttcgtcaggcgtccggctgccgttgtggcggccggcggcgcgccgggtgcggtgcacctcgacgtcgcaacgattgtgtgtgcccgatgcacggccggcaaacgatatttccgcacagggtgatgcaggattgtcatcaacttgcgtcgtgttgcgatgtgtccgcctgcccgtctgcgggctttggaaacgtcccatatcggcgcgcaagcgcatcggatcggtgtgccgaggtgttgcgttttcggaatgaagtcgtgagttaatatcaatagcggcccgacttgtggccaccgacaatgtgtttcatggatcgtgccttgcgaggcgggagcgcgccgtccggccgggcttccggcggtggcgcggcacgatgcgccgtgcggcgcaccgggcctgccgcgcggcgcatccgcttgcacagggcgcgcgaacgcgctcaatcgaatcacgcgggcggcgctgccgccgcaccgatcaatctgtccctgaagaggaagtgatgcaattcaacgacattcttgccgcgctcgatatcgatctcgcccagtggaaaggcaatgcgctgaccgcgcgttcgccgctcgacggcgcgacgctcgcgacgctggccgtcgacacgcccgccgacgccgagcgcaagatcgacgccgcgcacgacgcattcctcaagtggcgcacggtgccggcgccagtgcgcggcgaattcgtgcgcgtgttcggcaacgtgctccgtgagcacaaggccgaactgggccgcctcgtcacgctcgaagccggcaagatcacgtcggaaggcctcggcgaagtgcaggaaatgatcgacatctgcgatttcgcggtcggcctgtcgcgccagctctacggcctgacgatcgcatccgagcgcccgggccaccggatgatggaaacgtggcacccgatcggcgtgtgcggcgtgatctcggcgttcaacttcccggtcgcggtgtgggcctggaacgcggcgctcgcgttcgtgtgcggcgattcggtcgtgtggaagccgtccgagaagacgccgctcaccgcgatcgcgtgccacgtgctgctcgagaagcgctccgcgagttcgagaagacgcatccgggcgtcgcgccgaagggcctgagccagctggtgctgggcatgcgcgatgtcggcgaggtgctgacggcgtcgaagaaggtgccggtcgtcagcgcgacgggcagcgtgcggatgggccaggaagtcgcgaaggtgctgagccagcgtctcgcgcgcggcatcctcgaactcggcggcaacaacgggatgatcgtcgcgccgagcgcggacctggatctcgtggtgcgcgcggtcacgttcgcggcggtcggcacggccggccagcgctgcacgacgctgcgccgcctgatcgtgcatcgcagcctggtcgagcaactgctgccgcgcatcgagaaggcctacgcgtcggtgaaggtcggcaacccgcttgaagaaggcacgctggtcggcccgctggtcgatcgcgcatcgttcgatgcgatgcagaaggcgctgggcgacgcacgcgaacagggcggcgaggtgaagggcggcgagcgcgtcgacgtcggtcacgcggatgcgtactacgtgcgtccggccatcgtgcggatgccgaagcaatcggccgtggtcgagcgcgagacgttcgcaccgatcctgtacgtgatggtctacgacaacttcgacgacgcgatcgaactgcacaacgcggtgccgcaaggcctgtcgtcggcgatcttcacgaacgacatgcgcgaggccgagcagttcatgtcggcagcgggcagcgactgcgggatcgtcaacgtgaacatcggcacgagcggcgcggagatcggcggcgcgttcggcggcgagaaggaaacgggcggcggccgcgagtcgggttcggatgcgtggaaggcgtatatgcgccgcgcgacgaatacgatcaactacagccggcagcgccgctggcgcagggtgtgaagttcgacgtgtgatgtcgcgcggtgcatgttgcaccgctcgacgatgaaacgggccggttgccgcgttgcggtaccggcccgttgtgtttggcgcggcgcaatgcggtatcgtgcgcgttggcgtcgttcggcgccggtgcttttcgatgacatgccgggagcggcgcgcgtgcgtgccggcccgggttgacggtggcgagatcgtgaacggaaatgaatgtcttgcgcgcctcgcggggtgtcgcccgtcggcatgcaggtttatgcgtcttcctgtttgcgtcgctattgcgacgcgaaaggggtgtcgcacgcggccatcgatgcgctgctggctcatctcgacgccgtggcaggtgcccgaagcctgccggagtgggagcggcaaggcgcattgctcgaactgaacggcaggggcgaacccgttccggtagccatcgagtcggcgctgccggatggcgagttgcagacattcgcggcgctggtcgaagctgtcgtcgaggtcggaatcgtcgatctgtacggcgcgggcaccgatcttccgctggtgtttcttcgcaagacgatcgccgttctggagcagagcgggattccgctgccgctaccgccgcgcgtgactgggtaatgagtcgtgcagtgtggtaacggccggacgtgaatgccgcgcgcacgaagccgagagctagtggagcgaaatggaaaacaccaagggcaaggtcagggtcgtcattccggtcaagcggaaaggcatgcgggaaatggaagacttctacagccgcgcgttcgggttcgcgatcacggaagagggtgacgtcctgttgggtggcgacggtggatgtgtcggtcggtttgtctatcgggaaggaaaaggcgtacgcagtcaggaggcaatcctggatatcgagatcgaaaaggatttcggcgcgtactgtcgccacgtcaaggcatgcggtggacggttcgacatggtggcacggatgattgccggctacgcggcgcatctgcgcgatccgagcgacaacctgatcacgattgcctgttacgaagacgacgccgcgagcgacgagatcgtctacggctggaaagagacggtcacgatcgattgacacgatcacgacggggatacgaatggacacgctcgcggatctgatacggagcgaatcgctcttctacgcggattgcatcgcgttgagccgcacgcgcgtgatcggctacacgattgccggtgcgcgactagcactggacgatacgatcggcgtcgaagaatccgatgtcaccgacgcattcgaacgattctcggtcgagatcgacggcgcgacctatgcgggcggcgagggcgcgtcgcacgggtcatacggattcttctacaagcgcacgggaaacgatgtcgactgggtcgtgatgtcgacgacgtcggacccgttcgtcgccgcccggcacacggacagcggcatcgcatttgtgacccaggccggcgatgcatgggtggtatccgcggacgatgtcgcgaacttgcgcatcgtccgcggacagcctgtccggcaggtcagcgcgaatccacacgacgcatagcctgcatcactgctccgccgccggcatgttctgcacgaccagcatctgcgggctcgacagggtgatgcccgccgcgcgcaactgcttgaggatctcgaacagcagatcgctcttcgtcgagctcgcgatccgcgggctcgacacgtagcccgtcacgctcagcgtgatcccgtccggcgtgagctggctgaacgtgaccgacggcgccggcttctcgaggatcgcctggtgctcgcggtacgcgtcgagcagcaggtcgcgcacctgctcgggatcggtgttcagcgggaacgtcagcaccagcgtcgcgacgccctgcgtgctgttgcccatcgtcacgttgcgcacgttctgcgagatcagctgcgagttcggcacgattacggtcgagcgatcgctgagctggatctcggtcgcgcggacgttgatgcggcggatgtcgccttcgacgcccgcgatgctgaccatgtcgccgaccttcaccgggcgctcggtcagcaggatcagccccgacacgaagttcttcacgatctcctgcaggccgaagccgatacccaccgacaacgcgctgacgatccacgcgaggttgttccaccgcacgccgagcagcccgagcgtcatcagcaccagcagtacgtagccgacgttggtgaacagcgtgatcagcgatacgcgcatcccggtatccatgccgagcgcgggcatgaactcgctgtcgagccagcgtcgcagcgagcgcaacaggtagaagccgatcgcgaacccgattacggcgttcaggatccggtcgggcatgatgttcaggctctgcagccgctggctgccgatcatcgcgaccgcgctgtcgagcaggtcgcccgggtcgtgccgaagccgcccgtcaccagcgcgatggccgcgatcagcatcagcaggctcgtaccgaagccggacagcaccgtgcgcgcctggtcgaggtggcggtcctcgagcgcgaacaggtgcttgatctgctgccccgtcgacaggctcgacgagaacaggctttcgctcgcgtcgcgcgtcaactggatcaggatgtaggtcgtgcacagcacgatctcgaaccacacgagttcgtacgtgatgaagcgcgcgaccgtgacgtaaccgatcaggagtgcgatcagcgatgcgacgatcgccagcgtgacgcaggcatggatcagccccgcgagcgtcgagcgctgctcgggtgcctcgcccgccgccgcgagcgcggcgcgcgcgcggttggcgcgcaacagcgacgcgccgaccgtcagcgtgacgacgagcgacacgatgccgcgaccgaacagcgtgaccgacaggctggtgtcgacgatccggttgatcgattcgagcgtgccggacacgagcagcagcgcggccaggatgccggggaacggcttcatcgcgagcgcgacgggatcggcgagcgcgggaggcgccacgacggatgcttcgtgcagagcagtgcgcggccgagcccggcgatcagtgcgcaggtcgcggcgagcttcgcgaactggtcccacagatcggtcagccccggcgtgaggtcgtaacggcgcgcgacggcgaggtaaaggatctgaacggcaacggcggtggccagcagggtcgacagcgcgatggacagcgccagcgcgctgcggcgcaagcgggtggccggcaggcggttcacgcagaaccaggcgagcccgcgctcgaggagccggcggccgccgagccaggccgcgatcgcggcaatcagtagcagcgcggtgatcgcctttgtccgggcacccacgacgagcgcagcatgtcgtggatttcctcgtcgaagtccccgagccgctgggtatcgtccggcgaaagatggaacagcggcagccagaactgcgcgctgaaaatgccgcccgaacggaacgcgagctggttcttcagcaggctgcgatgcagcttcgcgaactgttcggcgaggttcgtgaggttggtcttctggtcggcggcctgcttcagcgccgcatcgagctgcgtcttgcgcgcgtcgagcgtggcccgttgtttcgcgacggctgccgtctccggcgcggcgccctcggcgggcggcggcccgagcacgtcgagctgtgcctgaatctgcgcgcgttgcggcgtgagatcgctttgcagtttcacgacgtcggcactcagctcctgcgccgagtcgtcgagcgcgtccagctccttgctgctcgacgcggtcgaagtctgctgcttgatgcggtcgagttcgacctgcatctgcttgagctgcgcgacggcgtcgttcagcgagatggccggcacgggcgcgccgacgccgcttgcgcccggggcggaagcggcctccggaaacgccgacgcggttgcgatcgcagcgaactgcagcaacgcgatcagcgcgatccggcgagcgtacgtggatagtcgttgtatggacatggaatgcttacgatttgccgacaaggtcgggcgccgaaaggtgcccggaagccggtggttggcccggtagcatgttaccggggtgtggaacgcgtggttgtactgattgcgtgccccgtttgtggagattccggcggcgtgcggccgagcgaaacggcgcatcaggcccggacggtggggccgccgccgcgatgcgtcgccgggtcgccgttcctgcgcgttttccgtacccgacagacggttacgaaagttacacgttggtccgcccaaaatggggcacccgaatcggttcgacgtacggcgtgcagccggcccgtcgtcgcgctccggatatcggggccggggtgcgctcgcgtcggacggacgtaccggtacaatgcagcgattcgcccgacggcggctcgaaggtcgccggacaactacacgacacgacaggagacgcgcccacgatggcctcaacggacagcctttcgcaggcacccgcccaatccccacccgtcgaccccggctccatctcggcccgcctcgaccgcctgccgcccacgcgtaccgtctggaagctcgtcgtcctgctgagcctcggcttcttcttcgagctctacgacctgctctacagcggctacgtcgcgcccggcctcgtgaaaagcggcatcctctccgcgacgacgcatggcctgttcggcaccacgggcgtcgcgagcttcatcgccgcgctgttctcgggcctcttcatcggcacgatcgcatgcggcttcctcgccgaccgcttcggccgccgcgcgatcttcacgtggtcgctgctgtggtacacggccgccaacgtcgtgatggcgttccaggacaccgcggccgggctgaacttctggcgcttcgtcgtcggtctcggcctcggcgtcgagatggtgacgatcggcacgtacatctccgagctcgtaccgaagcagatccgcgggcgcgcattcgcgtgcgagcaggcggtcgggttcgtcgcggtgccggtggtcgcgttcctcgcctacctgctcgtgccgcacgcaccgttcggcctcgatggctggcgctgggtcgtgctgatcggcgcgcacggcgcgctgttcgtgtggtggattcgccgcgaactgccggaaagcccgcgctggctcgcgcagcagggccgggtcgacgaagccgaccgcatcatgcgcgcgctcgaggcgaaggtcgaagccgaatacggacggccgctgccgccgccggcgcccgccgagcccgtgccgccgcgcggcagcttccgcgacatgtgggtgcagccgtatcgcaaccgcacgatcatgatgacgatcttcaacgtgttccagacggtcggcttctacggcttcgcgaactgggtgccgacgctgctgatcaagcagggcatcacgatcacgtcgagcctgatgtattcgagcgtgatcgcgctcgccgcaccggtcggcccgctgatcggcctcgtgatcgccgaccgcttcgagcgcaagtcggtgatcgtcgcgatggcggcggcgatcgtcgtctgcgggctgctgttcagccagacgacggtcggcgcattcctgatcgtgctcggcatcggcctcacgctcgccagcaacatcatgtcgtacagcttccacgcgtatcaggccgagctgttcccgacgtcgatccgcgcacgggccgtcggcttcgtctattcgtggagccgcttctcggcgatcttctcgtcgttcgtgatcgcggccgtgctgaagggcttcggcaccttcggcgtgttcgcgttcatcgcgggcgcgatggtgatcgtgatggccgcgatcgggttcatggggccgcgcacgaagggcatcgcgctcgaagccatctcgaagtgaccggcgatcgtgcacgcgtgtcgcacggttcgtgctgcatgcgtgccatgcgatggcatcgcactgcgcggccggtgcgtacggctcgtcgggaatgatccggtttccgaatcgattcggcgaagccctcgcaccgcggcgaaaaagcagcgccctttgtcggactcgaatgtccaaccagcaagattgccatgcatcgaaagatgcaggcggcaacgagttgaaacaaagcgtgacgaagcgcaaattcgccgtgaaaccgcgacttgcgtcgctgaagattcctgttcggacgcgtagaatgaagggcctgacgactcattagccgccatcggaccgtacgcgttgcatcggcgaacggctccgccgcgaagaggcgtctgcgccgggcgcacacgatgcgccggacgtgtcgatggctcgcgcggaagatgcgccgcccgcaacagcagcatgcggcggccggatcggccgatggcttcgaacgtatgatgcttttcagcctgacgcggcgcatgtcgaagtcgcgttgccgcacccgcacagtcgccgcgtatgtgtcgctcgctgttgccctgatcgttcccgtgcttgccgggcagcctgcgtttgccgcgtccgacgcttcgtcgtccgttgctccgtcatcctcatcagttgcaccgcccgcgtcggcgatgtctcatgcgcatcgtggcttgcctgcgcatgcgtcgtcgggggcgtcggccgtacagcccgcgtctgcagcgtcgcacgagcgtcatgcggagcctgccagcgcggcatcgggggcatcgactgcttccggcacttccgctgccgatgccgcttctgccgcctcagccgcttccgccgccgcgcccgccaccgccgcttccgccaccgccgcgagcgaggccgaagcacccgcgccgacaccgccacgccgtcatccgccgctatcggccgaagaggcgaaaatgcgacggcgcgcgcggtcgacatgcgcaagcgcttcacgcaggaagtcacgcggcgcctgaacgtgcccgcaagcgagcagcgcgcctacagccagcggctccaggaggcgctcgccgatgcggatctcggcgacctcgccggcgaatacatcgcgatggtcgaccgcgcgccgaacgtgcaggcgctcttcatctacttccgtgcaacgccggccaacgcgtggctgatgatcggcacatcgccggtcggcaccgggttgccgggcaagtacgaccatttcctgacgccgctcggcgtgttccatcactcgcccgacaacatggatttccgcgcggaaggcacgacgaacgagaacggcattcgcggctacggccgccgcgacatgcgcatctacgacttcggctgggtagacggcgagcgcggctggggcaagggcggcgtgtcgccgatgcgcttccagatgcatgcgaccgatcccgaccggctcgaagcgctgctcggcatccggcactcgaagggctgcgtgcggattcccgcgtcgctgaacacgttcttcgatcgtcacggcctgctcgacgacgattaccaggcgcgtgtcgaggccggcaagtcgctgtgggtgctgcgtcgcgaccgcgacatcacgccgatcgcgggccgttatctggtcgtggtcgacagcgcgcgcaagacccgcccggcctggtcgccgatgccggggcgcaacgcgtggtcgaaggtgccgaagggcggcgacacggcggattgaccgccgatccgcggggctgacggctgctggcgatgccgggatgagaataaatccgttttattgatacataagaaaagcaaacttttattatccgatccgggttcgtatagtcgaggccagtttcgcggaaccctgccgcgcctggaccaccaccgatcacacgacccgcatgaaaactctctacaagcttgccccgctcgcgatgctcggcgccttcgcgacgcatgcctgtgcgcaaagcagcatcacgctgtacggtctcatctcggccggtgtcgggttcgcgaccaaccagggcggcaagaacgcctggcaggcgctgtccggcacgaaccagaacccgcgctgggggctgaagggcaaggaggatctcgggcaagggctgtccgcgatcttccagctggagaacggcttcaacgtgatgacgggcacggccgcgcagaacggccgcgagttcgggcggatggcctacgtcggccttgccgaccgcacctacggctcgctgacgttcggccgccagtacgatgcgatccacgactacatcgggccggtgatcatcgcgagcaacggtgtgaacatcggcgacaacgacaacggctacaacgacatccgcgtgcagaattcggtgaagtacgtgagcccggtgtaccacggcctgaaattcaccgcgctgtacggcttcagcaatgcgacgggcttcgcgaacaacagcgcctacagcttcgggctcggctacgagcagggcccgctgcgctggagcgcggtctacgcgcagtacaaccacccttacagcgcgacgaaccaggacggcgcgatcgcgaacgactacgcgtcgccgctgctgatcttcagcaagagcgcgatgacgcccgcggcttacgccagccggcagcggatcgcgggcaccggcggtttctacacgatcggccgcgcgcagttcgccgcgatgtttaccgacgtgcgctacgattacctcgacaattcgcacctgcacctgcagaacctcggcgtgaacatcgtctacacgatgacgccgcagctcttctcggcgccgcgtatgcgttcacgaacggcaagtacgacatgatcgacaagcggccgaaatggcaccaggtgaacctgcaggccgattactacctgtcgaaacgcaccgacgtcgcgctgacggtgatcgcgcagcaggcggccggcgacgcggaccatgcgcagatcttcgcgtatgcgcgctcgaccggcacgcgccagatgatggcgacgctcggcgtccggcacgttttctgagcgcccgaccatgacccatccgatcgcatcccgccgcaccttcctgaaactgtccgccgcgctggccggcaccgcgctgctgcccgaaacgggcgcgttcgccgccggcggcgatgccgcgcgccgcacggtgatcatcgataccgacccggggcaggacgacgccatcgcgatcctgttcgcgctgggcgcgcaggaccgcctcgacgtgcgcgcgctgaccgccgtcgcgggcaacgtgccgctcgacctgaccgaacgcaatgcgcggatcatccgcgactgggccggccgcacgaaaacgctgccggtctacgcgggctgcccgcggccgctcgtgcgcgagctcgtgacggccgcgaacgtgcacggcaagacagggctcgaaggcgtcgagctgcccgtgccgcgcgcgccgcttgccgccggccacgcggtgtcgtatctcgtcgatacgctgagccgcgcggcgccgaacagcgtgacgctgtgtgcgctcggcccgctgacgaacgtcgcgaccgcgctggtcgaggcgccgcagattcgcggtgcgctgcgcgagatcgtgctgatgggcggcgcgtttttcgagcgcggcaacatcacgccggccgccgagttcaacatctatgtcgatccgcaggcggccgaagtcgtgttcggcagcggcgtgccgatcgtcgtgctgccgcgcgatgtcgcggtgaaggcgccgatcacgccggcgcgcgtcgcgccgttccgtgcgctcggcaaccgctgcggcgtgatcgtcgcggacatcatggatgccgaactcgcgtacaacaagaagcggcgcggtgctgaggacgcgccgatgtacgacccgaccgcggtcggctacctcgtcgatccgacgctgttcggcgggcgcaaggtgaacgtgatggtcgagacgaccgggcagtggacgctcggcgagaccgtcgtcgactggaacgggcgcagcggccgcgcggcgaacgcgacgtggatcaacgaggtcgacgcggaccgcttctatgcgacgctcgtcgagcgcatcgcgaagctgccctgagcgcgggcgctcgtgcggcgaacggcgaaccgcactcggtcgacgccatcagatgtgcttcgcaatccactcgcggcacgtacggacatgcgggccgcgatcgtcgccggcgagcgagatcagcgagatcgcccgcgtgacgcgcggcttgtcgacgcgcaacgcaacgagttcgggatcgtgcagatgcatcgtatagaggctcggcagcacggcggtcgcgaggccgttgcgcgcgagcgcgtagagcggctcggtgtattccatccggtacgtgacgttcaggcgcagcttctcggcgccgccggtgcgatgcagcgattcgctgacgctgccgcgcacgaacaccgcgagttcgcgatcgacgagcttcgcccacgtgacgctcttcgcgcgggcgagcggatcgtcgtgccgcacgacgatcacgatctcgtcctcgaacagctgccggtagcgcagcgtgccgtcgtcgctgtcgggttcgcgtacgccgatgccaagatccgcgacgctgtcgcgcacggcctcgacgagtgcgctgttgggcaggtcggtgagcgtgaagcgcagcgtcgggtgggcgtcgcgcagtgcgttgagcgcgggcagcaggcggccggcgaccgacgggatgaacgcgatgcgcacggtctggatgcgttcgccgatgagccgcgtcatgtcgtcgaaggtgccgcgcgcctggttgagcaggcgttcggcgagcggcagcacggcttcgccggcggtggtgagcgtgagccggtgcgcggaacgcgcgaacaggcgcccgccgagcaggaactcgatctggcggatcgacgcggtgagcgcgggctgcgtgagcgacagcgcctgcgcggcctgcgtgaagctgcgtgcgtgggcgagcacgacgaagtgctggacctgccgcagcgtgagcgcgggcagcagcgacgagcggtcggacgacatcgggcaataacggtcgggatacggtacgcggcagtataagaccgcgctgcgtgcatcgacacaggacaatattcggaatcacaggagaaccaccatgtcagcgactgacacgatgccggcgcgtgcgccggccaactggctcgaacgccgcttcgcgctcgccgcgcgcggcacgagcgtgcgcaccgagacgatcgcgggcgtcacgtcgtttctcgcggccgcgtacctgctcgtcgtgatcccgtcgctgctcgcgacgggcggcatggagcgcggcgcggcgacgaccgcgacgatcgtcgtgttcgtgctgttcacgacgctgatggggctctacgcgaacctgccgttcctggtcggccccggcatcggcggctcggtgatcatcggcgtgacgctcgcgacgacggagcatgtgggctggcagacgggcctcggcatcgcgtgcgtgtccggcatcctgttcttcctgctgacgattctcggcgcgcgcggcgtcgtgatgaagctgataccggtgcagatcaagctcgggctcggcgcgtcgatcgggctgttcgtgacgatgctcgggctgcgcaatgcggggatggtcgtcgcgaatgcgaagaccaacgcgttcgcgctcggcgatttctcgcggccgggtgcgctcgtcgcgctgatcggcctggcggtcgcgatcgtgctgcaggcgcgcaaggtgcccggcgcgatcctgatcgcgatcctcgtcgcggcagcggcgggcgtgccgctcggcgtcacgcatctgcccgcgtcgttcgtgtcgctgccgcacagcatcgcgccgatcgcgttcaagctcgacatcggcagcgcgttgagcctcgcggccgcgccgtacctgttcgcgttcttcgcggcggaattcttctcgacgctcggcaccgccctcgcggtcggcgcgaaggcgaacctgctcgacgaacagggcaacctgccgaacatcaaccggccgttcctcgtcgattcgctcgcggcgacgatcgggcccgtgttcggcattcccgcgctgaccgcgctgatcgaatcggcggcaggcgtcgaggccggcggccgcagcgggctgtcgtcgctggccgcggccgtgctgttcgccgcgatgctgctgttcgtgccggtcgcgctcgcgatcccgaaagaggcgaccgcgccggcgctgatcctgatcgggctgtcgatgttcgcaacgatccgccatacgcatttcgacgacttcaccgatgcgctgcccgtgatgtcgatggtgctgctcacgctgatgtcgaacagcttcggcaccggcatcgcgggcgggctgctgtgctacgtgctcgtcaagctgctggccggccgccggagcgacgtgtcgtggggctcgtcgtgctcgcgctgccgctcggctattacttctggaccgtcgtgaagccgcactgagagacggctttcgcgacgtatcggcactacccaaaacgagactgcaatgaaggcaacaccaggtaacgtcccggccgcgcgcacgggcatcgagatcacgccggcccatcgggccttcttccacgcgctgccgaaggtcgagctgcattgccacctgctcggcgcggtgcggcacgacacgttcgtcgcgctcgcggaacgcagcggcgcgccgatcgagcgcgcggagatcgacgcgttctatgcgcgcggcgagaagccggtcggcgtgctgcacgtgctgcgcgcgctcgacaagtatctgctcacgcggcccgatgacctgcggcgcatcgcttacgagtatctggaggatgcggccgcgcacaacgtgcggcatgcggaatacttctggaacccgacgggcacggtgcgggtgtcggggatcgcgtatgcggacgcgcaggccgcgatcgtgacggcgatccgcgacgccgcgcgcgacttcggaatcggcgcgcgcctgatcccgagcatcgaccgcgagcaggatccggacgaggccgtggcgatcgtcgaatggatgaaggcgcatcgcgcggacgaagtggcggggctcgggatcgactatcgcgagaacgaccggccgccggagctgttctggaaggcttaccgcaatgcgcgcgcggccggtttccgcacgaccgcgcatgcgggcgagttcgggatgccgtggcgcaacgtcgagaccgccgtggatctgctgcaggtcgatcgcgtcgatcacggctatacgatcgtcgacaaccccgagctgtgtgcgcgctacgcggaacgcggggtcgtcttcaccgtcgtgccgacgaattcgtactacctgcgcacgctgccgccggagcaatgggcggaacggcatccgatgcgcaagatgccgggcctcgggctgaagatccatccgaacaccgacgatccgacgctgcacaaggtcaacccgtcggaggcgtgggagctgatgttcagccacttcggctttacggtcgccgatctcaagcaattcatgctgaacgggatcgacggcgcgtgggtcgacgatgcgacaaaggccgcgtggcgcgcggcgtgggcgccggagttcgacacgctggccgcgacgctcgcagccggttgagcgcattgcctgccacatcggccggccggtacttcgttcaggtggaaatgcagccttgcgggctggcgcacgtcggtcgcgttcgctatattggcgtccggcggcacccggtcgtgccgctgccgccgtgcgcgcccgcgccggcattccgacaactattcgaatcctgagaggcccgccgtgcgtattcctgttttctgtctgatgttgttcgtctcgatgtccgcgcgagccggcagtgcctgcgacgggctgctcggcgattacgcgccggccgccggcaagccggcgacgctgcgcgtcgagaaagtgggcggcaagatcgtgctgcgcgggcgcgacgccggccaatggagtgtcgaaacggcaccgacgcaagaggccgagctggaaaccgacggccctgacaaggcgccgccgggcgcctgtgtgctcgaggtgccgggcggcgagctgatcaagatgccgatcggctcgccgtatcaggtcacgtcgatcacgggcaacagcttcaccacgaagcattcgaccacgggcgtcctgctgcgcacggtgcagggcttccaggtcgacggcaccgagctgtatcgggtcgcgcgccgcggcgattcgccgccggccgcggcacgctgacggcgtgcgagccgacgtaccgcaatacacgacgacacgacgacgagggcgacccttccgatgggcaatcgatcatggctctatctccaggccggtgacggcgacgacgcgcgaacgatcgagttcgcggaatccaacaatcactttccgctgctgtggcgcgtgctgctggccgacggcggcgcgggcgacgcgataacggatcagcgggtgttcggcgacgcaggcacgccgaacctcgccagcgatgcgcgcgcggcgcatgcgcgactcagccggctcgcgtcgttcgtcgtcgcgtatccgctgcccggcgacgatccggcgctcgcgcgccagttcgatgcgctcgtgcgtcacctcggcgagtcgatcgatgcgttcggcgatgcgcatggcgcaccgcggctgtccgcgaatctcgacgaactgtcatggctcgacggcggcgatccggacgaatacatccgcgaggagcacgacaactgcacgcgcctgtggtggcgggtcgcgaactgcatggattttcgagacgtgcgcggcgtgcgcgacgtgctcgagatcgatacgcccgccgactggcgcgactgggcgtggggcttcgggttcggcggcgtgtcgcatcactatttccagcgacaggagccgccgcgcggcgtggcgtttgccgagatgttcgacgccggcgaagtgcacggcaactggctcggctacggcacgttcagctttcgcgcgcgcaacggcctgtggggcgtgcggcgggaagtcgacgacgcgtggcgcgtgatcgtgccgcccgagtggacgaacctgtggacgagcggcgcgcgcgatcgccggttgctgtgggccgcgcgcgacgggaaggtcggcctgctgttcgccgatgccgatgtcgatggcgacggcgacgagatgcggatcgtgcgcgaaccggcgttcgacgccgtgtgggatttcagcggcgacgtcgcgtgcgtgcgcgtcggcgagcggttcgggctcgtgggcacggacggcacgtgggtgctcgaaccgtcgctcgacgatttcggcgaattcaccggcggggttgcgtccgcgagcctggacggccgctggggcttcgtcgacacgcacggtgcgtgggtaattccgccgcgcttcgacgatgcacatgaattcgtgaacggcgccgtcgcggcggtatccgaaggcgagcagtgggggctgatcgggcgcgacgggcaatggcgcgcgccgcccgagtgggccgcgctcgaatggtcgtccgaatgcggcgccttcctcgcgtggcgcaacggccatgtcggcctggtcgatgcgaaaggccgggtcgtcgtcgagccgcattacgcggaaatcgccacgctgaccgacgacgaacggacggacatgctgtccgagcttggcgcgatccgccatgtcgtgcggcgcgacgacgggcgttgcgcgatcgtcgacgggcagggccacgtgttgacgccgttcgatttcgtcaacatgggggcgctgccgtggttgcccgatgacgaagccgtgccgggcgaactgttcacgcgttacgcgatcggcgtgctgccgggcgagccggcgaagtttgcgatctgcgatctcgagacgggcgcgacggtcgtgcaggggcgctacgacgacatggccggcctgttctggggcgccgatcacggctggctggcctgcgtgcaggacgagagcggtgacgacgtgcgggcgacggtgtttcgcgcggacggcaccgtgctgcatccggcgcgttacacgcggatcggcgacgatgcgctgttcgacgacgatcccgacgccgctgccgggcacacgacgttgatgccatggtacgtccgtcgtgtcgaggtcgcgcagaactggagcatgggcgaaccggtcgccgcgttgcgcgacgacggcgtacccgtatggctgtacgcggacgggcacgcgacgacgacgcggcggtagccggggccgccgtcgtccatgccggcgtggcgtgccggcacgacgatcagcggaagaacctcagccagtcgaacaggccggggtgcggacgccgtttcggcgccggcgccggtgcgctgcgcggccggaagtcgggcgagaactgcgcacgcggatcgatcgcgcgcgtacgcagtgccgcatcgtagaacgccccgacgatcggcaacgcgctgtgcgcgcccgcgccccagtagtcgctgcgcagcgtcacgttgccgtcgtcgaagccgacccacgcaccggccaccagttgcggatgcatcaggatgaaccagccgtccgtgttgtcctgcgtcgtgccggtcttgcccgcgacgtcgacgcggatcccgtagcgcgaacggatgtcctcgccggtcccgtaatcgacgacgccgcgcatcacgtcgaccagcgtctgcgcggcggctaccggcaacgcgcgttcgggcggtgcgctgttgaatgcggcgagcaccttgccgtcacgatcctcgatgcgcgtgatcatctgcggcgcgacgtacacgccccgattcgcgatcgtcccgtaggcggacaccatttccttcagcgtgacggggctcgtgccgagcgcgagcgacggcaccgcgtcgagcgggctttcgcgcacgcccatcgcgcgcgcgagctgcgcgaccctggccgcgccttcgcgctgcatcacctgcgcggtgatgcggttgcgcgacagcgcgagcgcgtcgcgcagcgtcatcggcgcgtcggtcggcggctcggcatcggtcggacgccacaccgcgtgcgtgccgatcgggatcgcgacggggcgatcgacgaacgtgtcgcccggccgcatgccgtccgcgaacgcggcgccatagacgaacggcttgaacgtcgaacccggctggcgccgcgcctgcaccacgtgatcgaacggctcgctgccgaagtcggggctgccgacccatgcgcgaatcgcgccgttgcgcgggtcgatcgcgacgaagccggcctgcacctgcgtcttgcgttcgcacaacgcatgcatgaacgcgcgattcgcgccgagctgcttcagcgcggcgacatcggcgagcccagcggcgcgcgcgtcgcgatagtcgggcgtctgccggatgaagccgcggaacaggtcgttgcgcagcccgcagccggacgggccgcgccatgcgctgtcggcgactgcctgcaggcgatcggtttgctgcgtcagcgcttgcgtcgccatgtcctgcagttgcgcatcgagcgtcgtgcgcacgacgaggccgtccgagtagaggtcgtagttgttgcggtcggcccaggcgatcagccacttgcgcagctgcaccgcgaagtgcggagccgggcccggctgagcggtctgcggctcgaagtcgacgcgcagcggccggcgctgcaattgcgcgagctgccgcggcgacagcatgcccatcgccgccatccgcgcgagcacgatgttgcggcgctggaccgcgcgttccggattcagcaccgggttgtagtagctgttgcccttcagcatcccgacgagcgtcgcgctttcgacgatgtcgagctggtcggccgatttgccgaagtaggtacgcgcggccatctcgacgccgtacgcgttgtacaggaacggcacggtgttcaggtaggtctcgagaatctcgtccttgctgtacaccgtctcgatcttgaacgcggtgatcagctccttcaccttgcgcgtgagcgtcggtgcgcggccgacttcgtccgggtacaggttgcgcgcgagttgctgcgtgatcgtcgagccgccctggcggctgcccgagaacgtatgcagcccggccgcgagcgtgcggcgccagtcgatgccgtgatgcgcgtagaagcggtggtcctcggtcgcgatcagcgcgtcgaccatgtgcggcgagatctgcttgagcggcacccattcgcggttgacgggccggaattcggcgatgatctggccgtcggccgacagcacgcgcgcggggcggtcgatgcgggccttgcggatgtcgccgatgctcggcgtgaacggcacgaacgcgagcagcaccagcaggccgaccagcgggatcgcggcaagcgtcagcgcgacgccgcggcgcgtcggatggcgcaggcgatgccatgcgccggcgcacagcgcgcggatgcgcgcgcggctggcggcggccagcggtgcgacgcgggcgcggcaacggagccacgcgtctcgaagaagcggcacgaagcggttcaaggcggcaggagcgcggatggaggaggcgcgatcctagcaaacgacccacgggcgacgcccgctaaaacggccgtttgcttgcaggatttacagacgattacgtttgttgcccgtcgacaaccttttgcggcacccgccgccgcgattccgctgacgatacgacgtccgcgagccgctgcgcggccgcttccatctgcgcgcggccgaacccgccgaagcccagcacgagccccgggcgggccgtgcccgacgcgaacatcggcgacaccgcgcgcaccgcgacgccggcttgcgcggcgcgttcgaccacgtcgagatcgtcgatgccgtccgcgagccacagcacgacgtgcatccctgatcgcccggctgcacccatgcgcgttcgcgcggcagccgcgcaccgagcgtgtcgatcagcagcgcgcgctgctccgcatacacgccgcgcacgcggcggatgtggcggtcgagatggccttccgcgatgaacgcggccagcacgtgctggtcggcggtcggcacatggcgatccatcagtgcgcgcgcgccgcagaacgcgggcacgagatcgtcgggggcgatcacgtagccgagccgcagcgacggaaacaggatcttgctgaacgtgccgaggtagatcacgcgatcggggtcgagaccctgcagcgacgggaacggataaccttcgtagcgcagctcgctgtcgtagtcgtcctcgaccacccacgcgtggcgtgcacgcgcccacgcgagcagcgcattgcgccgcgccatgctgagcggcatgccgagcggatactggtgcgacggcgtgacgaacgcggcgcgcgcatcgggcgcgaggcggatgccggcgtcgacgtcgaggccgtcggcgtcgaccggcacgcgcaccatcgcgtcgtgtcgcccggtgctctcgagcagcgcggtgatgccgcgataggccgggttctcgacccaggcccggtcgcccgcgccgagcagcagctggctcgcgaggtgcagccctgctgcgtgccgctcgtgatcacgacctggccggcatcgcagcgcaccgagcgcgaacggcgcacgtagtcggcgatcgcttcgcgcagcggcagcgcgccttgcggatcggcatagccggacggcgcgccggcgccgcgcgcgcgcaggcggttgccgagccggcgccagatgtcgtcgggcgcggtgaggccgatcggcaccgagatcgcgaacggcatcgccggcagcgggcggaattcgcgggcgatccgcgcgaaggcggcggccggctcgggcagcccggcgtggaccgcgcgccgtcgtggcgcaggcggcgcgggttcggggccgggcggcggttccgcgagcgcgttcgcgacccgcgtgcccgcgccgccgcgcgattcgagaaagccttcggcgatgagctgcgcatacgcatcgacgacggtgccgcgggcaacctgcagcgacgtggcgagcagccgcgtggacgggagcgcgtcgcccggccggacgtcgccgcgacgcacggcttcgcgcagcgcctgcgcgagctggcggctcaggtcgccggccgcgcggtcgagcgcgccgagcgacgggatttcgacgatccgggtcgttcttgccatgattctggtctgctgaaattgttccaaaccggctctacagcataaaccagtttgaagtcacaatcggcgggtgacgggctcgcgcccgcgccgcttccaaccccgcatgactgtggagccgacatgtacgtccccgccgaattcaacgagcccgaccccgacgcgatgcgcgagctgatcgtgcagcatccgttcggcagcctgatcacgcacggcaggaacggactcgacgcgaaccacattccgttcgagctgctgcccgacgacggcgggctcggcgagctgcacgcgcacgtctcgcgcgcgaatccggtctggcaggacgtcgcgaacggcgacgaggtgctcgcgatcttccgcgcgggcgacgcctacatctcgccgacctggtatccgagcaagcacgtggcgcaccggcaggtgccgacctggaactacgtggtcgtgcacgcgcacggccgcatcacggtgcgcgacgacgagaagttcgtgcgcggcgtggtcgcgcggctgacgcgcacgcacgaggcgtcgcagccggtgccgtggaagatgggcgatgcgccgaaggactacatcgacaggatgctggcgtcgatcgtcgggctgcagatcgagatcacgcggctcgtcggcaagcgcaagctcgggcagaacaaggacgaagccgatatccgcggcgcgggcgaagcgctggtcgcggagggcaacctcgcgatcgggaggcgatgctcgcggcggccgacgcgaaacgcgagtgacgcgcgtgacgcgcaagcggcgtgcacgccgtgaccccggcggcgtgcgcgggcgcgtgccacgcccgcgcaccggctccgtcattgcgtgcgcgtcgcgcccttcgtgccttctcccgcctgcgcgagcgcatcgcgaatcgcggcctcggtcttgtcgtacgcgccttcgccatagcgcgtatagacgacctttccgctcgcgtcgatcaggtagagcgcgggccagtactggttgccgtacgcgcgccacgtgtcgtagcggttgtcctgcgcgaccgggtaccggatgccgaagcgcctgatcgcatcggcgacgttgcccgcgtcgcgctcgaacggatactcgggcgtatgcacgccgaccaccacgagcccctggtcgcgatacttgcggtcccactccttcacgtacggaatcgtatgaatgcagttgatgcacgagtacgtccagaaatcgacgagcacgaccttgccgcgcaactggccgagcgtcagcggcgcgctgttgtgccagcggtcgatgcccgtgaaatcgggtgccgccatcccggcctgcgaggccggcatgctcgcatcgtcgcgggtgccggcgaacgcggcgagcccggccgtggcggcgagggcgatgacgagggcggcggtcttgagtcggggcagcatggcgttctcctgagcgggaggccgccgctcggaggcggcggccggacgggtttcgacaggccccattaggcggcgccgacgtatctgcgatgtgtccggcaagccgcgcgtgtgcaatgttgtgtgtcgtcacggcggcgcgatacattgggatacaaacgcgcgcccgccgtgcggtataaaagcggacatcgcctgcctcgactcatcgatacctcgataccgaaacgacccatggacaagatcgaccacgtgctgatcgtcgacgacgatcgcgcgatccgcgaactgatcgcggattatctggagaagaacggcatgcgcgtatcgctggccgcgaacggccgcgagatgcgcaacgtgctggacgacggcgcgcccgacctgatcgtgctcgacctgatgatgccgggcgaggacggcctcacgctgtgccgcgacctgcgcgcgggcaagttccgcacggtgcccgtgctgatgctgaccgcgcgcggcgaggaaaccgaccgcatcatcggcctcgagatgggcgccgacgactacctcgccaagccgttcgcggtgcgcgaactgctcgcgcggatccgctcggtgctgcggcgcgcacgcatgctgccgcccggcatgcaggtgacggaaacggccgcgatgctcgcgttcggcgaatggcgtctcgacacgaccggacgccacctgctcgataccgacggcacgctggtcgcgctgagcggcgccgaataccggctgctgcgcgtgttcctcgacaacccgcagcgcgtgctgacgcgcgaccagttgctcaatctcacgcaggggcggcagtccgacccgttcgaccggtcgatcgacctgctcgtgagccggttgcgccagcgcctgcgcgacggcgcgcgcgagccgcgctacatcaagacgctgcgcaacgagggctacgtgttctcgtcggccgtgaccgccgtcgacggtacgccatgagcgcgcgcacgttgacgtcgtggcactggccgcgctcgctgttcgcgcggctcgcgttgatcctgtgcgtgggcctcgcgctcgcgcagacgctgtcgttctggctcacggtgaccgagcgcgaccaggcgaccaccaacctgatgatgggctacatcgagcgcgaggtcgcaagctccgtcgcgctgctcgaccacctgccgccggccgagcgggccgcctggctgccgcgccttgcgcggcgcagctatgcgttcatcctcgggcccggcgagaccggcacgccgccggaagcgaggctgtcggcgcgcgtcgagcggtcgatttccgacggcatcggcggcgactatccgctgaccgcgaacgcgatccccggcgaccgtgaacatctgcaggtgcatctgcgcctgaccgacgggtcgccgctcacgatcgacatccatccgatgtcgacggtgccgctgtcgggctggctgccggtcgtgctcttgctgcagctcgcggtgctggccgcgtgctgctggctcgcggtgcggctcgcgacgcggccgctcaagcagctcgcgcaggccgccgatgcgctcggccccgacctgaagggcgagcggctgaacgagggcgggccgtcggaagtcgcgcgcgccgcccgggcgttcaacgcgatgcaggatcgcatcgcgcagtacatggccgagcgcatgcagatcctcgcgtcgatctcgcacgacctgcagacgccgatcacgcgaatgcgcttgcgcgtcgacgtgatggacgacgacacgcagggcgcgaagctgcgccaggacctgctcgagatggagcatctggtgaaggagggcgtggcgtatgcgcggacgctgcacggcaccgaggaggccgcgcgccgcatcgatctcgatgcgctgctcgacagcatcgtgtgcgattacacggatgcggggcaggacgtcgcgctgcacagccgcgcgccgctcgcgctcgtcacgcggccgaaggcgctgcgccgcatcgtcggcaacctcgtcgacaacgcgctgaagttcgcgggcgcggccgagatcgacgtgcacgccgcgcctgacggcggcgcggtgatcgccgtgctcgaccgcgggcccggcattccggacgatcagctcgacgcggtgttcgagccgttccggcgcgtggagacgtcgcgcaaccgggagacgggcggcacggggctcggcctcgcgatcgcgcggcaactcgcgcttgcgatgggcggcacgctcacgctgaacaaccgcgcggacggcggcgggctggaggcgcggctcacgctgcgcaatgcggggtgacgggggcggcgcgtgagccgcggggtttcaggttcgtgccgaagccgtagcggaaactgaagccgaagccgaagccgaagccgaagccgaagccgaagccgacgcgcgcgacatcacacgcgccgcagatgcgcatcgacgagcggcgcgagcgtcgccgcatgcacggccgcgagatcgtgccggccgcccggcacgacgtgcagctgcgcgtcgggcagccgctcgagcaggcgccggccggccgcgacggggctgagcggatcgtcgtcgccccacagcagcagcgtcggctgcgcgatgccgccgatttcccgcgacaggtcggcacggaacgtcaggaaccagtcgggcaactgcgggttggcttgcgcgaacccggcccgccagtcctgcgcgccgagccctgccatgtcgagcccgccggacgtgaccgtcagtacgaggtgcgtgaccaggccgggcttgtcgagcgccgcgcgcatcgcgatcacgccgcccatcgattgcgcgatcacggcggtcggccggtcgatcgtttccagggcatgacgcacgaggctgtcgaaatcgtcgacggccggatcgcgcggcgtgtcgccgaaacccggatagccgacgattcggcgttcggccggatgcgtcaggctgccggcgagcggttgccagaaggcggtgctgcccgatgcgccgggcaggaagagcagttgcgacggaacgggcatggtggcgcggttttcctgtgaatgaagtaacagcgggcggcgcgtgtcagcaccggccggtgcgcagcgcgacggtccagtcgtcgcgcccgcgcgatgccgcggtggcggccgccgtgtgccagtcgtattcgaccgcatgaaattcgacgttccagccggccgccgtgcgcgacaccatcgcgtagcgcgcatgcggcgaacccgtctcgatgcggtgcgggtgcggcaggtcgtccgcgtacgcctgcagcccgacgctgcccgggttgacgaccagccggccgtcgtcgagtctggccgtacgcgggatgtgcgtgtggccgcacaggatcagcgatgccggttcgtcgcccgcgcgttgcgcgatttccgcgggcgtcgccgcgcggcagccctcgggcgtgacggtttcgaggaaataggcgaggtcgctgccgggcgtgccgtgcaccatcaacacgtcgccgtcgagcgtcgcgcgctcgggcagcgcggcgatccatgcgagatggtcggcgcgcagcgtgtcgtgcgcccagcgatccgacagccgcatcgactcgcgatcgccgccgagcagttgccgttcgtgattgcccctgatggtcggcaggtcgagcgcgatcaggcggtcggccgtttcgggcggatggagcgcccccgacaggatgtcgccgagattgacgatcacgtcggcgccgcggcggcggacgtcgtcgagcaccgcgtcgagcgcggcgaggttgccgtggatgtcggacagcgcggcgattttcatggcggatcgtcggggaagggaacggcgattgtcgccaattcggcgcaggccgtccaatggcgtgcgcgtgcgatgccgcaggtcgtgagcggttgggcgtgaagccgcgggtggcgcgtcagtcggtcgcgaggcgtgcgtacatcgcgaaatcgcccggtgtgccgcgcaccatcctgtacgcgcgcaacagcccttcgtagcggtagccgcacttctgcagcacgcgcgcggagcccgcgttgccggtcagcaccacgccctgcatgcgcatgaagccgccgtccgcgaaggcccacccggtgacggccgcgcacagcgcgctcgcgaccccgcgcccccagtgcgacggcgcgagatcgtatgcgatctcggccgagcggttcacggtggagacggtatgcaggccgatcgtcccggcgagcgcgcccgatgcgtcgtcgatcacggcgagacgccggatcgaatcggggtcggtcgattcgatggtgtcgaacagcggcagcagatcgtcgggcgcgcgcaggttccagctcgtgtggcggaagacgtcggggatcgacaggtacgcgtaccacgcgtcgaggtcggcgcgttcgagctggcggagcgacaggcccggaaagccggagcggggcggtgcggcgattttcatcggtgtccgcccctacgccgcatgacgccgatacaacgccagcgacccggcgagcgcgagcagcatcgcgccgcacgtgcgttcgagccacagcgcgcccgcgcgcttcagcagccgcaccgcgcgtgcgccgagcagcgcgtagccgaacatcaccgcgccgtcgagcagcgcgaaggtgaccgcgagcgcgacgtattgcggcgcgagcggcgcggacggatcgaggaactgcggcaggaacgcggagaagaacaggtagcccttcgggttcgttaccgccgtgaggaaactcttcgcgaagatcgacgcgttgcgcccggataccgcttcaccgtgcgcggcggcgacgtcgagcgaacccttcgacatcagcagccggatgccgacgtacgcgaggtaagcggcgccgagccacttcacgaccgagaaccagaacgccgacgccatcagcagcgcgccgaggccgagcgcgaccgcgacgatcagcacgaaatcggacagcatcgcgcccgcgaagccgtaggccgcgcgtcgcacgccgtagcgcgagccgttggtcagcgcgagcagcacggtcgggccgggtgtcgcgatgccgacgagggcgacggcggcgaagaccagcagggtcgtttcatgcatgacggaactcccgagggaaggggcgcgctcgattatcggctgcgcccgcccgggctgtacagcgacggcgcgccgcgcacacggccgcccggtcgactatctcgattttggcaataaacatttttcattattccgcttcagattgaaaccggttccatctaccatggcggccgcagcgggcatgcccgccgcgtcgtcgcgcgcggacgatgccggcctcgcaccgccggcggatctcgccgcccgcgcgctactcgcaactgacagccagaacaacgggttcaccgcccggagacacgacaatcatgaacaagcaactgatcgcagccccgctgctgctcgctcgcgagcgtcgccgccgcgcaaagctccgtcacgctgtacggcatcgtcgacgcgggcgtgacctatcgcagcaacgaacgggtcggctccgcgggcgcgtacaccggccattcgaacgtcgggctcacgaccggcaacctgtccggcagccgctggggcatcaagggttccgaggatctgggcggcgggatgcgcgcgctgttcgtcctcgagaacggcttcgacatcacgaacggcacgtcgggccagggcggccgccagttcggccgccaggcgttcgtcggcctcggcagcgaccgctacggcacggtcacgctcggccgccagtacacgtcgctcgacgacttcgtgagcccggtcggcccgtcgtcgttcatcggcggcttcggcgcgcacccgggcgatatcgacgacctcgaccagacggcgcgcgtcaacagctcgatcaagtacacgagcgccaactactcgggtttcacgttcggcgcgctgtacggtttcggcagccagccgggcagcatgaagcagcgcaacacgtggagcgtcggcgcggcgtacgcggcgggcccgctgcgcgtcggcgtcggctacgagcgatcggacaacagcaagacgggcgcgaccgacccgacggccggcaagtggcagagcaccgacgacgggctgttcaactcgtcgatcaacgaaggctatgcgagcgcgcagtcgcagcagatcatcgcgaccggcgcgacctacgatttcggcccggccgtcgtcggggtgaactacagcaacgtgcagtaccgcagcggcgaccagtcgcggttcacgggccacgcgacgttcaacgtcgcgggcgtgttcacgcgctggaacgtgcgcccgcagacgcaactgttcgcgggctacagctacacgcgcggcagcgatgtcgatggcgtggacgaccgcgcgcagtatcacaacgtcacgctcggcgccacctacgacctgtcgaagcgcaccagcgtgtacctgctcggcgcgtaccagcacgcatcgggcatgacgctcgacgcgctcggccggccggtggccgcgaccgcgtcggtgtccgacaaggcgaacggccactcgtccgattcgcggtcgcaggccatcgtcagcctcggcctgcgccagaagttctgacgcgccgcgatcgttgcgtccgcaacgttgcccgcagccgatgcgggcgacggtgcaggcatggccctatactgtcgcctccgtttttcgaggagacgacatgacccgaacgcattccgcgagttgcctgtgcggaaccgtcaccgtgacgttgcgcggcgagccggcggcgcgcgcgaactgccattgcgcgacctgccgcgatttctacggcacgccggtgctgtccgcgaccgcgtggccgccggagcaggtggccgtcgagggcggccatgcgacgttcccgcatccggcgaagtcgatgtcgcgcacgtattgcgcgtcctgcggcgagatcgtgtgcggcaccaaccggttcggcatgcgcgtcgtaccgaacagcctggccgcgcgtgcgcacggcgggcaactgcccggcgacctgcagccgacgatgcacctgttctaccggcaccgcgtgatcgacgtcgtggacgcgctgccgaaattcctcgacggctgggacggcccgaccctcgacgacgcgaactgaacgatcgcggctgcgtgccggcatggccggcgcgcggttctctccgccgtatcccgctttctccttccttcctcccgccgcatgccgccgcgctgaatcgcaccgacgcgatcgagccggacaatatttttccctttcatttcaatttcgatttgtaatcatcgaacccatttccggggaatgaaaaaggcaatgcgggtaattcagaaaaatgacgtatttgcattgaacaatccggaagaaaatgccggggaaaagcgccgaaaccgtgcggcccgcaagccgttgcggcgtgatgggcgggtttgaccatcgttgacggaaaagcgccgtacggcaaaaagaatggcgtgaataattcgggatgaaggcgaatgcgctttagccggaatcaccaatatttcatgtgccgcgatttacagtgtcgacaattgaacgttcgggagcattattcatgtcaatgaaacaaattcgggcggcattgctgggaatgtgcatggcgatgctggcgccggcgagtcacgcgcaggtgtcgtactcgaccgactggctcgcgaacacgtacggcacgctggcccagcacgtgggcaacgccgcgcgctcgatgtgggtcgccccgagggcgtgatctacacggcgtcgcgctgggacgagaacgcgggcggtgtcgcgctctaccagaacggccagccgatgggcacgatcggcatccacgacgaattccagggtggcgcgatcaccggcaacgcgacgtcgatcttcgtcgcgctcggctacaaccgcaacttcggcagcggctcggtgggccgctacaaccgcggcacgaaccagcgtgacctgcgcatcccggtcagcacgtggacgggcctgccgaatccggacgtgatcaccggcctcgcgaccgccggcaacctgctgtatgcgagcgatttctacggcaaccgcgtgcgcgtctatacgaccgacggcgtctggcagcgcgacatcggcgtgaccgggcccggtgcgctggcgctcgatgcggcgggcaacctgtgggtggcgcgcatgagcgcgggcgtggtcgtgcagtacagcgcgaccggcacgctgatgaacacgatccagatggcggccggcgcacggccgtcggcgctgtatttcgacgcgtcgacggggcagttgctggtgggcgaccagggcccggacatgaacatcaagctctacagcctcgccgggtcgccgcagcaggtcggcacgttcggcgtgcagggcggttatctcgacacgacatcgggcatcaaggggcaggtcggcgacaagcgcttcacgcgcgtggtcggcatcggcaaggatgccggcggcaacctgtacgtgctcaacaatgcgtggggcgggggctgggatctcgggcgcaacggcagcaccgacctgcattcatacggcccgacgggcgcgctgcaatggaagctgcaggcgctgaacttcgaggcgatcgccgcgcccgacccggcgaccgacggcgcgttcttctatagcggcaacaacgtgtacacgggctcggcgggcggcacgttcgtcgcgaacacggtcgatccgttcagctacccgaaggacccgcgcctcgacatgaacgactaccagcgcggccagcacttcggccagctcgtgacggtcggcggcaaccggatcctcgtcgcgtcgggccagaaccccggcaatttcaacttctactacttcacgccggcgaccggctacatcgcgaatccggccggctcgctgccgggcaagccgttcaacacgacgctgcaggtcacggccggtttcgacatcgacggcaacggcgacgtgtgggccggcttgaacggctcaaacgtgattacccgctacccgatgacgggtttcgacgcgaccggcaagccgtcatggggcaagccggtcacgacggccgtgccgggcaccgtggcgcccgtcacgcgcatcatctaccaggcggacagcgacacgatgatcctcgcgcagggcctcgcgggcaactgggactggaccgcgatgaacgggcatatcgaggtctatcacggctggaagaacggcaacacgagcgcgccgaacccggtgatcaacctgacgagcgcgaacccgaaatcgatcgcggcggccggccactacctgttcgtcggctacgtgcacaccgtgccgaacgtcgacgtgttcgatctcaacacgggcgccctcgtcacgacgctgaccaactcgaacacgtcggcgatggatgtcggcaacgacgtcgactcgatgtacgggatccgcgcgtacctgcgctcgaccggcgaatacgtgatcacgaaggacaactacaacggcaccagcatgatcgtgtatcgctggcgtccgtgaacgcgcgagcggagcaggccgcgcggtctgcacggcctgctcggcgcccgcgtcacggcgcgccgagcacgcggccgttcacgctgagcccgtacatcgaatcgggcgaatcgtggaatttcgcgcgcgtgtcgtgcaccgagcccgtgaagcgcgggtcctgcggacgttcgtggctgtccatgaaggtcgcgacgtcccacgcttcctgatcggtcagcgtaccgccgagcccgagcggcatgttggccttgatgaagccggccgcattgcggatgtcgcccatccccgcgccccagttgaacgaacgcgcgccccacagcgccgggaagaccgccttgccgccgctcgactgcccctggccgtccgcaccgtggcacagcgcgcagtgctgcgtgtagacggcggcgccgcgcgcatagtcggctttctgcgcgggcggcggcagtttcaggaaaccctgccccggcagcttcgtgccgaccggcgcgcccttcgcgagccagtacgaataggtttcgagcgcgacgagaatcgggtcgccggccggcggcgccttgccgttcatgctgtagcggaagcatccctgcaggcgctcggcgaacgtgttcacgtggccgttcttgctgcggtacgccggatacagcaggtacgcggcccacatcgggctcgaatcgggccgccggcccgcgtcgaggtggcagctcgcgcaggtcagcttgttgccgacgtacttgcccgcgaactcgggcgtgtgcaggaagatctgctcgccgagcttcacggtcttgccgaactcgtcggcggggatcgcggattcggcgggcggcgcgaacggcctggctgccgccgcaacggcggaaggcgcggatgcggaagcgttggccggtggtgcatcctgcggtgcggccgcgaacgcgagcgcgggcaaccaggccgcgccgagcaatgccgtgcgggtgcggcggatcagcgtcgtgcggtcgatcatcgcttgtctccctgcgcggcgccgccgcgtgcgtagtaggcggccactgcgtcgatgtcggcgtcggacagcttgccggcgatcaccggcatcagcgccatcggcccgggcgggcgcgtgccgtgtttccagccgttcaactggccggcgatataggcggcgggctggcccgcgagcggcggaaacgcgctgcccacgccgaggccgccggggccgtgacactgggcgcatgcgggcaggccttgcgaccagcgtccgcgcgtcgcgagccacgcgccggtgttcgccggatcgatcgacgtgtcgtcgtcggcggcgatgccggccggtgcgggcaggctcgcgaagtacgcggataccgcatcgcgctcgtgcggcgtcagcagtttcgagagcggctgcatgaccggattctggcggctgccgtccgcgaacgcggcaagctgcgcggacagatacgcggcgttcgtgcccgcgaggcgcgggaagccggccgccgcgttgccttcgccctggccgccgtggcagccgatgcaggcggcgacgcccgtcgtcgacccctgtcgcgagcgtcttgccgagcgtcgcgtcgtccgcgcgcgcgtggccggccagcagcgtcgccgcggcgagcagcagcggcgcgaaccggcgtcgcggtgtgtgcaccgtatcgttcacgtgtcccctccttgttgtaggccgcgagcgcgccgccgggcagccggcgcggccgcgcggtcagcccgcgtcgggctgcttctcctgctgcgccggcgcgaggtgctgcggcggtgtcgccgcatcgtatcggccgaagccgtagcgctggaagatcccgaacgctgccggcgaccggatgaacgcgagccatgcgcgcgcggcttccggatgcggtgcgtccttcaccatcgcgcccgcatagatcgcagtcgtattctgctcggccggaatgtcgatgtgcatcagcggatgcccgacctgttcctggaacgccgcctcggattgccacagcacgcccgcgtccgcgcgcccctgcatcaggaacagcgcggtttcccgatggtggatgtgcgtgagctcggtcgtgccggcgcgcaccttgtcgtcgtagacggtacgcgcgagcgcgttgccgccggccttcacgaacgacgcgcggatctgccgcgcgacgccttcgaatgcaggattgggcatcgcaagctgcacgtcgggccgcgcgaggtcgttcagcgacgcgatgcgcttcggattgccggcgcgcaccatgatcgtcagctggttcgtcacgtagggcacggccgggccgacgagcgtgccgtccgcgatcaagccgtcgatcttgccgagccccgcgaaatacgcgtcgggcttgaccgtccacgtcatgttgccgacggtgatcgtgccgcccgcctggatctgcttcacgagcaggccgggcgggatcgtctcccagtagatgcggccgcggtactcgggatggtcttcctcgaacttcgcgacgagcggcgccattgcgaagaaatagttgccgccgacgaacagcacgagcttcggcgcggtgaggtcgccgtggaaatcggcgagcacgtcgacctgcggcaccgtgaattcgaggccgcgatgcgtcgcgtcgttgttgcggccgtcctgccagggcgggaagacgttcgcggcgggggcggccggcgcggcgagcgacagcgccgatgcgcagcagagccaggcggccagcgcggcgcgcagcgtgcgccgacggcggagcaacggtgacggcggttgcatggggatcgatgtcatcgcggtgctcattttgcgtacgtgaagccggcctgctgcagttcgggcagcgtgccgaccgcgcccggcgtgacgattgccgacggaatcacgtggttggtcaggtcggccgcgagcgcatcgagcggcagcttgtcgggattcgcgttcgcgccgtcgagccgctctgcgagttcccagatcgcgttgtggcacgacaggaacacgacgccgcgctgctgcagcgcggcgatgctgttgtcgtgcgacgagaacgcgccgtcaggcgactcgtggttttgtgcgcccttcgattgcgcggctttcgcgtcgagcagcgtgttggccggaaaggcggcgccggcgaatttcgcgaggccgtatttgtcccacgcggcctggtcgaacagcgcgagatgcgcgctgccgtgcgtggccgatacgacgaggaaatccggatggcgatacgaccagatctgcgcgttcagcgaattgcgcatcaggttcagccacgggccgccgagctcggtgttgtcccatacctgcttcgggccgccgcggtagccggtcagttcggcgagcgccgcgtgatcccactggtcggggcgttcgaggatcatcggcaccgtcttgaagtcgcgccgccgcggcgcgccgcgaggcggcgcgtgaggtcggcgaggtgcgtggcgccgccgggcagcagcgcgccggtttcgggcgcggcggcgcgagcgggcgcgcggcggcgagcagcgcggtgccggccgcgaggccgagtgtcttgagcgcgcctcggcgcgcgtgccggtcggacatggggtatctcccggaatcgtttttgtgggggcgtgccgcgttgcgatacggcgctgctgcgtcgcgaatgcgtagccagtctagcggcgcgcgtccggtacggaaaatcgcggtatcggatgggagatattcgggtggctgatgattgggcggccggggttggggcgatcggtgaaacgaccatcggttcggtcattccactcggcttcggtcggcgagcccgtcgttgaggggcttcctgcggacggttccggttccggttttgatcggcgaatcgatcgtcctttgatacggatggctgattatccggaacgggctgcacaggatcgacttgtataatcgcctcctgcgaatgcacacatgccttaccgagagagaacgttactcatgaattgggacgatgcccgcgtttttctggccgttcatcgcaccgggacgctgcgcgaggccgcggccgttctcgacgtcgatcaggccaccgtggggcgacggttgaccgcactcgagaaggcgctcggtgcgaagctgtttctcaagacatcgtcaggttatgtcgtgacgcaggtcggcgagcattcgctgcacgccgcggaagcgatggagcgggcggcgtgcgaattcgagcgtcgcgtccagggctcggacgatcgcctcgaaggcgaggtccgagtcacgacgaccgattccctcgcgatggatttcgtcgttcccgcgatacgggaactgcgccggaaatgtccggcgatacacgtgatcctgacgacgtcggtgcaggtgctcaacctgacgcgacgcgatgcggatctcgcgattcgcaccgtgatgccggaaaatcccgacctcgtgcgccggaagctcgccgaatgggaggtcgggctgttcgcgagccgcgagtatctggatgcgcatggcgagcccgcgatcggagccgcgttcgaagggcatgacctggtcgtctaccagcccggcacgacgtcgaatcaggggcacgcgctgtgtggcgagtcgatggaacgcgggcgcatcgtggcgcaggtgagttcgagcctgatgctggcggcgtcgatccgctcgggtatcggcatcggtgaactccccgcgtatatggcgcaagacgacgattcgctcgtgcgaatctggcccgaccggacgcgagccgtgccgtatcaggtctggctcgtatcgcataccgacctgaaccggacggcgcgcgttcgggcggtcaccgcggagatcgcggctacgttcgaccgttatcgatagcggtcggggcctcgcccgcgcagggccacgggctcaacggggtagcgtgtcgcgcatcgagcgtgcgccgcgcggcacaccagcgcggcacgatcgcgatggccgcgacgatcgcgaagaacgggatggctgccgccagcacgtggcttccggtgccgagcaggccgccggacacggtggcggcgagcgacgcactgccgatctggaagaagccgaccagccccgacgccgtcgccgcgcgcccgtgttcgctcgcgatggcgcccgagaccgcgagcgacagcgacgatccattcgacaggctgacgagcaccatcggcatcacgatcgcgacgacgcctttgacgtgccacgattcgcacagggcgaacgccacgccgccggcaacgaagcagcccacgccggccacgacgatcgagtcgtaggacatccggtcgagcatgcggcgcgcaatcaggttggcggaaacgatgccggcggtcagcggcagatagagccagccgctttgccgttccgaaagaccgaggccggagaagatgaacggcgactgcgtcaggtagacgaaccacgcgcaatagatcgcgcagacgacgagcgtgtagcggatgaaggcccggtccgcgagcacgccggtgaagccggccagcggtgcggcgcgatgttgccccggcgcgaccggcagccgggtttccttcaggcgcaactgaacgagcgcgagcgcgacgacgccgaatgcggcgacgaaaatgaaatcgcttcgccacccgaaccacgcagccagatatccgccgattgcgggggcgattgccggagacagcgacacgagcggatacacgatgctgtagatcttcgcagatgcgttcttgtcgcaggtgtcggcgatgatcgcgcgaccgatgacgaggccggacgccgcgccgagcgcttcgagcacgcgccatccgagaaagctcgcgaagccgccggcgctcgcgcagccgatcgagccaaggatgtacaggacgatgccggccgtcagcacgggtttgcgccccatcgatcggagaggggccgtagaccagttgcgcacaggcaagcgcgatcaggtaagccgataccgtctgcggcatctgccatgcgccgatcgaaaacgcgtgggccatcgacggcatcgcgggcagatagacgtcggacgcgatcaggccgaaggcgctcagcatggagacgacgaggatgagtgagaggttggacatgttcgcaggtggttggagcggagcgcttgagcgaatggagaggtagacgcgcatcgggccgccgtggaaaaagccggggcgatcatacggcgcgcgatgcggtaaggagcaggcggaattgcatcgcacggatgcatttttgcgggcggtgaagcgagtgccggggaggcgtgtgaatggtggcgtcgggtgccgcgaggaacggcagtcaagcggaatccggcgctggtgtgggcggcaagcaacggggtgattcgctgtcgttcctgcttcgccggcggatcggacgatgttcggtcgccgcgttgttggtggttgtccggcacaacgcgcgcggagtcgcggtgaccgcttgcgaagcggcaaggatgcttcactggggcaggggcgagccgctacgcgtcgcgagcggctgcgaatgcgggcgtggtgcatgggccgccgcgtttgggccggcccatgcacgcatcgggcgatcggaacgtcagaccatcagaacgacaccgtcgtcgtcagcgtgacgagccgcggctcgccgaccgcgacgatcaggttgctgttgctcgacgggtagtaggtcttgtcgagcaggttcttcacgttgagctggaagcgcgtcgggaacttgccgatcgtcgtttcgtaggccgcgaatgcatcgacggtcacatagccgggcagcgtgaagctgttcgccgtgtcgccggagcgtgcgccgacgagacgcgcgccgccgccgaagcgccagcggccgggcagattcgcgatggccgtgtcgtacacggcgaacaggctgcccgtgtggcgcgcgacgttcgtgagcggggtgttgctgtcgcgatcggtcgcgttcgtatacgcatagctgccgatcacgctcaggtggcgtgtgatctgcccggcgacgtcgagctcgatcccgcgcgagcgcgcggtgccgatcgtcgacgtgatgtcgccgaccgtgaccgcgacgttgcgcttgtcgatctggtagacggcgagcgtgccggtgatcgcgggcttcaggctgaacttcagcccggcctcgagcacgcggccgtattccggcgcgagcggcgcggcgacgttcgatgcgacgttcggcttgaacgaccggctcacgttcgcgtaggcggtcagcgccggcgtgagcgcgtaggcgagcccgaactgcggcagccagacgctgccgcgcgagcggtcggcgaacacgaacggccgccccatccccgattcctgctgccagttttcccagcgcagcccgcccaccgcggtgaggcggtcggtgatcttcaccgagtcctggacgatcgtcgaatacgcatgcacgaccgagcgcgaatcgctttgcttcgcgttgggcgtgccgcccgccgcgagcaggccgtacacgggatcgtagagattgaagcccgtcgtcgccttgccgcggatcgtgtcgccgcggaagctgcgctgccgttcgtattcgccgccgatgtagatcgcgtggttcatcccggcgagcgtcacgttgccgagcaggccgagcgtcgcgatctggtcggagtcgttgcgtccgaggttcgcatcggacgagcgcgtcatcgcaccggtcttgctgttgaacgagttgccgcgggtgatggtttggtcgtagcggtcgcggccccagccgtaggtcgcgcgcacgcgccatgcatcggagaagcggtgctcgacgcgcgtccgcagcgtttcctggatgccgctgctttgcgaccatgcttcttcgtagcggcgatagcgcaacgcatcgtcgagctggccgttcacgagcacggtgccgcgatcgaacggcatcgtgtagtcgacgtactgatagctgacgtcgaccgacgtgttcgcgtcgtgccacgatagcgcgggtgcgatcagcgcgttgcgctcgcggccgaagctgcgccagtagcggctcgtgtcgtattcgccggtcagccggaacgcgagcgtgccgcccgcgacctggcccggcttgccgagcggccccgtgagatcgaactgcgcgttgctgccgccgtggctcgtgcgcgatgcggagatcgagccgccgaacgtgtcttccggcttgcgcgtgacgaggttgatcacgccgccgggatcctgcatcccgtacagcagcgaagcggggcccttcagcacctcgacgcggtcgatcgtcgcgagatagctgtgcagcaccggcgtgcgcacgccgtcgaccagcacggagccgtcgttgttcgacccgaagccgcgcttgatgaacgcgtcgcgcgtgccgccgagcgtgttggtttgcgtcacgccgctgatgttgccgagcacgtcgtcgagcgaacgcgcctgctggtcctgcatcacgctgctgctgaccaccgcgaccgattgcggaatctctttcaacggacggtcgttgccgcccgcgatgctgctggtgcgcggctggtagccgatggtcgggtcgacggtcgacgatgcgttgacgttgatggcgggagttctttcccggccggcgttgcgggtgccgatgcagttgcaccggcttcggcgttggccgcatgcgcgccgcttgcgacgcaaagggtaatcagggcaggcaggctcgagcgccacggacgcggggtccggacgcggcggggcgttcgacgggatggcatgaatcgatacaggagggaatgctaaggatcgtgtcgcgggccgcggcgtttcgttacggccaaggcgtgcatgatatatgtaatgagaatcatttgcaattgtaatgacatgattgccggggctcgggcgtcggttgccgggctggcggccgtctgctaccgtagcggccaaaatcagacgcagtgaaattcaacgagagagccggggccgcaccatgtcatcttcctgtcacgtcgcgttcagcgcgacgccacgcaccgcgcacgaccacgcgggcgatgaagtgatcgcagccgtcatccgccattcgaacgattaaagcaacggaagcgagttcatccggcgttgcgccgggcttcaatcacttcaaccaccacgctagacgggagaccacccatgaagaagatttccgcgccgtttgcggcggccgcgcttgcggcctgcgcgctggcaggcattcaccaggctgcttgcgcggcttccgatgccgactccgcgatcgacgcgcactacggcgccgtgatcgaggcctacacgcaggacgcggccgcggcgaagtcgaagtacgacggcaagcgcctcgcgttcgtcggtgccgtgatccggatgggcagcgatccgggcggcacttacttcggcgcgctgacggccgatggcgagcagttcgatacgcatttcgacgtggccgaccaggatgcgctgaagccgaaattccccggtggcgaaatcaagccgttcgtcacgtcgacggcgtttcgcttcagctgcgtgaacgaaggctatatcgatgcgcccgtgttgccgggcctgaagctggcccactgccgtctcgccaactgaccggcgcacgcgcatccggcgttcagaacttctgctggatgccggccatcacgccgagctggttcatcccggtgccgaccgtcccgcccgcggcgaccgcgttcgcggccagcgtgctgttgaacatgtagcccaccgacgtatagacggtcgtccgcttcgacaggaaatagttcgcgcggccgacgagcagcgtcgcgttcgtgccgccttcgctgttttcccagcgttgcaggtagcggacgccctgaaggtcgagcgcgaggtagggcgtcgcgtagtacgtgccgccggcgaacacgatatcggcctgcaggtgctcggccgccgcgaggttgcggcggatccacccggcgcccagtttcgcggggccgatcttcacgtagccggcgacgatgtcgcgcgtgtcggtgtatgccggattgttcagcggcgcgagcgcaccaccgccgccgcgcatcacgtcgtgcgacgcggcgagcccgaaattgctcgcgtcataggcgagcatcgccgtgtattggcggcaagcgacgatgtcgccgggcacctgtccggcgcagcccgtcgccgacggcccggccggtccggccgcgtcgcggccgaagctgtaggtggcgccgagcgtcaccccgtggaacgtgcccttgtagccgatcgcattgtcgctgcgcgcgttcggcagataggaatcgaaatccgccatcgagtgaatcgacgggccgatcacgtccgcattggtcagcacgatcatcgacatgttcatctggcggccgagggtcagcgcgccgaacggactgttcacgcctacgttcgcctgtcgcccgaacaggcgcccgccgtagttcagtgcgcccgtgccgggctggaagccgttctcgagcacgaagaaagcctggtagccgccgccgagatcctccgtgcccctcaacccccagcgtgacggcacttcgccggtcagtgtcggcatacccgtgaacgatccgccatgtgcggcgttgttgtagtaggacacgccggtatcgatgatcccgtacagcgtgatgctgctttgtgcgcaggccggtctggccagcgccagcgtcagtaccatcgccgtcgcgagtgcggcgcccagtttcgttttcatggctgtctccaaacagtatgtagatatgcttatcgatatttttatggcccgagccgatccggggtgccgacgggtatcggcaaggctgcgggcgtcgtgcgttacgacatcgccgggtcgcgttgcctgcgcggtgccgcggcgcgcgtacccgccacggcgacggcgatcgccgcgccggccatcggcacgaggaacgcgagatacagatgggacacggaccagccgtcgtccagcagcgcaccgaccgtcatcggcgacaggatcgcgccgaggcggccgatgccgaccgcgaggccgatgccggtcgtgcggatttcggcgggatacggcgtcggcgacaacgcatacatgccggccacgcacgcattgatcaccgcgccgaggaataccccgaccgtcatcccgatcccgagcgagccggtgttcgcgccgaacacgaccattagtacgccgccgagcagcagcgtcgcgccgagcaggttacggaggccgaaccgtgtcgacagcaggctgaagagcgacgcgccggcaatgccgccgagattgagcagcacgcccccggtgaccccctgcgatgccgacaacccggcctgaaccagcagcttcggtgtccagctcacgacgaagtagaagctgcccatcacgagaaagaatgcgatccacagcgcgatcgtgcggcgcgtcagcggcgcgcgcagcacggccgtccagctcgacgcggcgttcgccgagtcgatggaggcagtcgccgccggcagcatgtcgatcggcgcgcgcttcattctcgcgaggatgcggttgattttctgcagcgcgttgtccggacgccgagccagcaggaagtcgagcgattccggcagcaatgcgagcaccatcgggatcgacagcaaggtcaggatgccgccgaacgcgaacacgctgcgccatccccacgtcgacagcaggtaaccggcgatgacgccgccgccggtcgcgccgatcgcgtagccggtcgactgcatgccgatcgcggcgctgcgccatttgctcgatgcgtattcgccgctgatgacggtcaggctcgccagcatgccgccgatgccgagccccgtatacgcacgcgtgacggcgagttgaagcgtgctgtgcgtggccgcgcaggccagcatcccggtcgagatcaccgcgaggcagagcaggatgatgcggcggcggccgacgcggtcggcgagcggcgcgatcagcaccgagccgatgcccatgcccgccagcccggcgctcagcagcaggccgatttccttgccgctcagtttccactcggccgccaggtgcggcgcggcgaacgcgatggccagcacgtcgaagccgtcgagcatgttcagcacgacgcaggcggtgaccgccatcgtctggaacgtgctcatcggggattcgtcgatcgtattgcggatgtttgcactcacgtcaaagatccttgtaaatagtatgactaattaaatggggtgaaatcgaagccggtgatggcgaatgggacgaaagcgattgaacgggccgacggggcatcccgcggaacgcccgtcgcgaccggcgggtgttgtcggcggggcggcgcgatgcttaagcgggttcgagcagcagccgctcgatcacgcgccgcgcgcgattggggcccgcgtcgacgtgaatgtcgatctggcggccgcccggaaaccgcagctggttccggtactgcgcttcgatcacggtcttgtcctcgtcgaacgtcgccgcggattgctcgatgaccgtttgcgcgacgcgctcgacgtcgtgttgcggattggtcgcgacggtccagaagtagtgcgtcgtcgtttccgtttcgggcgtgatgccgtggaagccgcgcatgtgaaagccgccgcgtgccggatcgtgcagatcgccggtgccggcgtccatcgcgcccgtccagatccggatgtgcgacacgtggaattcgatttcctgccagcgatcgacgcggcccgcgaacggccacgcagcggtataggttggcggcgggtcggaatccggcatccggcgaaccagcgtcacggtatcgccgtcgctgctgacgcgggtttccgcacccatgtgcagcgccgcgttgccgccgatcgttttcagatggacatagccgaggtggctcaggtccatcaggttgtcgtgaatcagttgatacggtgcgtcgtagtggtagtggccgccgccgaaccggtattgcggatcggcatggaacgcatagtgtggcggcgcgtttgtcggttgagcgtgcgcgtcggcgccgatccagatccacacgatggcgtcctgttcccgtaccggatacgacgacacgcacgccttcgccggaatccggtcctggccgggaatctccacgcacgtgccgtcgcggtcgaacaacaggccgtgatagccgcagcgcaggccgcgcgattcgagcgagccgcacgacaacggcagcgacttgtggcagcagcgatcctccagcgcgccgacttcccggacggcaaccggaacaggacgaccgggcggccgaggagcgtgcgggcgacgggtttgtccgtcagttcggatgacagcgcggcgacccaccatcggtcgaccgggaactgagtagtattgatcggtgcccgggcatgttgctccattgatcgtctccagtattgtggttggccgccgcgagtcgggcggtccgtctaccgatttgcagacctacagatcgaggaccagcaggtcgcttcgcgatcgcgagcagcacggcatgaactggtcgccggctgcctgttccgcttccgtcagatacgagtcgcgatgatcgggctcgccttcgagcacacgcgtcgcacaggtgccgcatacgccttgttcgcacgacgtcagcacgtcgacgccgttcgccgccagcgccgcgatgaccgtgcattcggccggcacgtcgatcaccctgccgctgctcgcgatccgaacttggaacgcacgatccgcgccggacgacgcaaccgcgccgccgaagaactcgtagtgcagccgcgcttcggcccagttgcgctcgcgcgcggcgttcagcactgcgtccatgaagccgcgcgggccgcatacatacaggtgcgtgcctgcgggcgcggaggcgagcacggcggcgaggtcgaagcgttgcccggggcgccgtcatcgacgtggaggcgggcgcgatcgtgaaacccggccgcgttgatccgctcgacgaaggccatgcgatcggtcgagcgtgcgcagtagtgcatgtcgaacggcatgccggacgagaacagccgttccgccatgctgaggatcggcgtgacgccgatcccgcccgcgagcagcaggtggtgcggagcgtcgggggcgagcggaaactggttgcgcggcatgccgatccgcagggtatcgccttgccggacttcgtcgtggatcgcgcgcgacccgccgcggccgtcggcatcgcgcagcacggcgatctgatagcgatcggcgtgttccgggtgattgcacagcgagtactggcgcacgagcccgcccggcaaatgcacgtcgatgtgggcgccggcttcaaagcccggcaacggcgaaccgtcgtcgctgacgaattcgaaaccgcagatgtcgcgcgcttcctgccacttgcgggccacccggaccgtcaaggtcgcggcgctcatgacgcctccttgatctgcgcgaccggaatcacgggccgttgcgggctcgccgcgttttcttcggcgagcagccgttcgatcaccttgcgcgacagcacgccgccggcgtcgatgttgagtttgagcagcttgcggtccggccactgctcgaggttgagctgctggcgttcgagcatctcgagatcctcggcgaagatcttgccctggccttcgcggatttcggcggtcagcgcgtgatcgtcgggccggaagttgcgcgccatgccccagaaataccagatcgaggtgtccgtctcgggcgtgatgaagtcgaccacgatcgacgacgccttcaactcggccggcgcgtcgtagccgccgtggcccgcatgggcgacgcccacttcgatcatcacgtggctcggcggcgtgaagcggcagatctgccagcggtcgaccggcacgtcgtcggcgagcccgttgccgcgcagcgccatccgccagaacggcggcggcatcacgttttccatgaagcggctcgtgacgacttcgtcgccgcggctgaccgtcttcggcggcgcttcgtcgatctccttctggccgatgctcgacgcatgcacgtaggtttcgtgcgtgaggtccatcaggttgtcgatcatcagccggtaatcgcaacggatgtgatagaggccgccaccgtgcgcccaggccgggtcttcggcccaggccagcgcgggcagtttggcgggatcggcttccaacgcattgcccggccagacccagacgaatccgtaccgctcgatcaccgggaagctgcgaatcggcgggaagccgccgacgcgctggcccggcatgccggccgccttgccgtcgcagcccatttccagcccgtgataaccgcacacgagcacgccatcgcgcacgaatcccaacgacagcggcgcgccgcggtgcgggcagaagtcctcgagcgcggcgacccggccgtccgccgcgcggtaaaacaccatcgactcgttgcagatcttgcggcccagcggcttgccgtcgatttcatcgggcgtgcatgccacataccaagcgttcttgagaaacacgttcgtcgtctccttcggggcggtgccgctgacatgcggcagttcttcattccgtgtactgaatgagattcagtgtacgcattgagattggccggggcaaggcgagcggtatactggttttcccgcgaaatggcgcgaggcagcgccatgccgtcggcgcgcgcaaccggcgcgcgccgtctatgtcatcgactcattcatggaaaaacgaatcccgccgacgcgccggctttcccgctcgacctgtacgacgagccggggcacctgatccggcgcgcgcaccagattgccgtcgcgatgttctacgagaagctgggccgggacgtgacgccggtgcagtacgccgtcctgcggatgctctacgagtgtccggggctcgatcaggtgacgctggcgcagcgggtggcgctcgacacgtcgaccacggccgacctcgcggtccggctcgaagcgaaaggattgatcgttcgcgaagtgctgccgcggcgtcagcggcgcctgctgctgacaccgacgggcgtcgaactgctcacacgcctgattccgtcagtgcaggagctgcgtgccggcctgttcgacgggatgggcgaggaagattcgcaggaactcgtacgcctgttgcgcaagttcgtccatttgaacaacgagcagagccgtgcgccgctgcgcgtcggcgaggattcgtagcggtcggttacgcgcggcgcacgatgcgacgtgcgccgggccgcgctcctgcgtcacgggcgtgacgcttcccttccagccgccgcacggcttccgccacttcattcctgaaccgcacgagcgccgcctgctccggcgccggcggctgcacggcggcccacagcatgtcgacgagctgcgtggccgtcgtttccgtgtcgagcttgcggtgcccgaggatcgcatcccacagcacgtgctcgatcggcccgaacaccatcgagcgcagcaggctcagcggcaggtcggtacgtacctgcccggctgcctggccgcgcgcgagcacgtccatcagcggcgcggtgtagcggcgctgcagcgcggtgagttcgtcgctcagcgcatgctgcttcgcgcggccttccgacagcaccagtgcgcacaggcccgtgccgttcaccagcattagccgcaggtgggtgcgcacgatgaacgcgaactgctgctgcaccgacgcttcctgcggcatcccgtgctcgaacgcggcgatgttttcgtcgtaccaatccgcgatgacgcgcgcgcacagctcgcgcttgccgcggaagtagctgaacaccgtcgcctccgatacgcccacgcgctgcgcgatctcggcggccgtcgcatgctcgtaacccttttcggcgaacacttcccggccggcgcgcagaatgtcctgcacgcgttgctgggatttgcgcccggcgggcgcgcgcgacgtgtcggcgcgatcggctttgacggtggcggtcatggtgtcggcggtagcggctgtcatctcggcatgatatctgagtgtcactcaaaaactattgacgccgaacccggcgaggcgcgaaactgtgcaaaatttacgctgtattggtcaatgaatcggtgcattcattcgatttgagcgaaactcagaaatcagtgggtgccacacactttctggagacggaggagacatgatcaacctgcccggtgtgcaattcatgctcggtgaagacatcgagatgctgcgcgacgccgtcgcgacgttcgcggcaaaggaaatcacgccgcgcgcggcggaggtcgaccgcaccgatcagtttccgatggatctgtggaagaagttcggcgatctcggcgtgctgggcatgacggtggccgaggaatacggcggcgcgaacatgggctataccgcgcacatggtcgcgatggaggagatctcgcgcgcctcggcgtcgatcggcctgtcgtacggcgcgcactcgaacctgtgcgtgaaccagatccaccgcaacggcaccgaggctcaaaagcagaaatacctgccgaagctcgtgtcgggcgaacacatcggcgcgctcgcgatgagcgagccgaatgccggctcggacgtcgtcagcatgaagctgcgcgccgacaagcgcggcgatcgctacgtgctgaacggcacgaagatgtggatcaccaacgggcccgattgcgacacgctggtggtctacgcgaagaccgacctcgaagccggcccgcgcggcattaccgcgttcatcgtcgagaaggggatgaagggcttctcggtcgcgcagaagctcgacaagctcggcatgcgcggctcgcacacgggcgagctggtgttccaggacgtcgaagtgccggaggaaaacatcctcggccagctcaacggcggcgtgaaggtgctgatgagcggcctcgactacgagcgcgccgtgctgtcgggcggcccgacgggcatcatggccgcgtgtctcgacgcggtggtgccgtacatccacgaccgcaagcagttcggccaggcgatcggcgaattccagctgatccagggcaaggtcgccgacatgtacaccacgttccaggcgtgccgcgcatatctgtacgcggtcggccgccacctcgattcggccggcagcgaccacatccgccaggtgcgcaaggactgcgcgggcgtgatcctctatacggccgagaaggcgacgtggatggccggcgaggcgatccagatcctcggcggcaacggctacatcaacgaatatccggtcggccgcctgtggcgcgatgcgaagctgtacgagatcggcgccggcacgagcgagatccgccggatgctgatcggccgcgagctgttcgcggaaacgatgtaacgccccacgtcacgcgaacggagccccgtcgatgccgatcatcgaatcgaaactgaacccgcgctcggaagacttccgcgcgaatgccgccgcgctcgaggcggtcgtcgccgatctgcgcgcgaagatcgaacagctcgcgcagggcggcggccaggccgcgcgcgacaagcacctggcgcgcggcaagctgctgccgcgcgaccggatcgcgcaactgctcgatccgggtgcgccgttcctcgagttctcgcagctcgcggcgaacggcatgtacaacgacgacgcgccgggcgcgggcgtcatcaccgggatcggccggatcgccggccgcgagtgcgtgatcgtgtgcaacgacgcgacggtcaagggcggcacctattacccggtcaccgtgaagaagcacgtgcgcgcgcaggagatcgccgcggaaaaccggctgccgtgcgtgtacctcgtcgattcgggcggcgcgaacctgccgaaccaggacgacgtgtttcccgaccgcgaccacttcggccgcatcttcttcaaccaggcgacgatgtcggccgcggggatcgcgcagatcgccgtcgtgatgggctcgtgcacggcgggcggcgcgtacgtgccggcgatgagcgacgagtcgatcatcgtgaaggagcagggcacgattttcctgggcggcccgccgctcgtgaaggccgcgaccggcgaggaagtgagcgccgaggatctcggcggcggcgatgtgcatacgcgcctgtcgggcgtggccgaccatctcgcgcagaacgacgcgcatgcgctgtcgatcgcgcgcaacatcgtcgatcatctcgcgccgaagatcgcgtcgccggtcgcgctgcgcgagccgaagccgccgcgctacgacgcgaagagcctgtacggcgtgatcccggtcgatacgcgcaagccgttcgacgtgcgcgaggtgatcgcgcgcatcgtcgacgattcggagttcgacgaattcaaggcgcgctacggcacgacgctcgttaccggtttcgcgcacatctggggccacccggtcgggatcgtcgcgaacaacggcatcctgttctccgaatcggcggtgaagggcgcgcatttcatcgagctgtgctgccagcgcaagattccgctcgtgttcctgcagaacatcacgggcttcatggtcggccgcaagtacgagaacgaaggcatcgcgcggcacggcgcgaagatggtgacggccgtgtcgaacgcgaaggtgccgaagttcacggtgatcatcggcggctcgttcggcgccggcaactacgggatgtgcggccgcgcattcggcccgcgcttcctgtggatgtggccgaacgcgcggatctcggtgatgggcggcgagcaggccgcttcggtgctcgcgacggtgcgccgcgacggcatcgaggcgaagggcggttcgtggtccgccgaggaagaggacgcgttcaagcagccgatccgcgatcagtacgagcgccagggccatccgtattacgcgagcgcgcggctgtgggacgacggcgtgatcgacccggcgcagacgcgcgacgtgctcgggctcggccttgccgcatcgatgaatgcgccgatcgaagacacgcgcttcggcgtgttccgcatgtaacggccgggagggctgaccgatgcgatacgaaacgatcaaggtaagcgaagccggctgcgtggcgaccgtcacgctcgcgcgccccgacgtgcgcaacgcgttcaacgagacgacgatcgccgagctgaccaccgcgttcgaatggctcgacgcgcatgaaggcgtgcgcgcgatcgtgctcgccgccgaaggcgccgcgttctgcgcgggcgcggacctgaactggatgaagaagatggccggttactcggacgacgagaaccgcgccgatgcgcgcaagctcgcgcgcatgctcgaggcgatccatcgctgcggcaagccggtgatcgcccgcgtgcacggcgatgcctacgcgggcggggttggtctggtggccgcggccgatatcgcgattgccgccgacggcgtgaagttctgcctgtcggaagcgcgtctcgggctgatccccgcgacgatcgcgccgtacgtggtgcgcgcgatgggcgagcgcgcggcgcgccgttacttcacgacggccgaggtgttcgacagcgcgcgcgcgcgtcgctcggcttcattcacgaagcggtgccggccgatgcgctcgacgaaaccgttgcgaagctggccgcgacgctcgtcgcgaacgggcccgacgcggtgcgcgcgtgcaagcggctcgtcgccgacgtggccggccgcacgctcgacgcgacgctgatcgagcagaccgccgactggatcgcgcgaacccgggccggcgcggaagcgcgcgaagggattgcgtcctttctcgagaaacgcacgccttcgtggcgtgaatgacggcgtgaccctaactttccggacgacaccgaagccatgttcgacaagattctgatcgccaaccgcggcgaaatcgcgtgccgcgtcgccgcgacgtgcaaacgtctcgggatcgcgagcgtcgccgtctattccgacgcggacgcgaacgcgaaacacgtggccgcgtgcgacgaagccgtgcacatcggcggctcggccgccgcggacagctacctgcgcatcgagcgcatcatcgaagccgcgcgtgcaaccggcgcgcaggcgatccaccccggctacggattcctgtcggaaaacgaagatttcgcgcatgcgtgcgaagcggccggcatcgtcttcatcgggccgccggtcgacgcgatcgcggcgatgggctcgaaggccgccgcgaaggcgctgatgcacgcggccgccgtgccgctcgttcccggctatcacggcgacgaccaggacgcggccaacctgcatcgcgaagccgacgcgatcggctacccggtgctgttgaaggcgagcgcgggcggcggcggcaaggggatgcgcgtggtcgagcgctccgacgatttccccgcggcgctcgcgtcgtgccagcgcgaagccgcgagcagcttcggcaacgaccgcgtgctgatcgagaaatacctgacgcgcccgcgtcacgtcgaggtgcaggtgttcggcgacacgcacggcaataccgatacctgttcgaccgcgactgctcggtgcagcgccgtcaccagaaggtgctcgaggaagcgccggcgccgggcctgcccgacgacgtgcgccgtgcgatgggcgaagcggccgtcgcggccgcgcgcgcggtcggttatgtcggcgcgggtaccgtcgaattcatcatgacgggcgacgcgttctacttcatggaaatgaacacgcgcctgcaggtcgagcatccggtcaccgagatggtcaccgggctcgatctcgtcgaatggcaactgcgtgtcgcatccggcgagccgctgccgcttcagcaggacgaactgcgcgtgcagggtcacgcgctcgaggcacgcctttatgcggagaacccggcgcgcggcttcctgccgtccacgggcacgctgaagcacctgcggctgccggcaggcgtcgagttcgcaatcggcgcatcggtgcgcgtcgacagcggcgtgcgcgaaggcgatgcgatcacgccgttctacgatccgatgatcgcgaagctgatcgtccacggcgcggaccgtgcggaagcgctgagcctgatgctgcgcgcgctgcgtgcatgcgaagtggtcggcctgcacacgaatgccgcgttcctgcagcggatcgtcgcgtgcgagccgttcgcgacggccgatctcgacacgggcctgatcgagcgcaatcacgatgcgctgttcgcgccgcaagagccgccgcgcgcgatgctcgcgctcgcatgcgccgcgctgttcgcgcgcgaacgcggcgcggccgcgcagggttcgtcgccgtggggcgcgctgccggactggcggctgaacggcggctatcgccgcacgctcgactggcatgcggccgagcgcgaagcggacgtgacggtcacgtacgaggacgacggcgctgtcgcgcgcctcgcgaccggcggcgcggccgcgcaaccgttcgcgtggacgcgtggcgccacgccgctcgatttcgacgtgacgctcggcggcgtgcgcagcagcggccgcgtgtatgcggacggcgacaccttccacgtgttctcgcaaggcgcggccgagacgttcgaatggcgcaacctgctcgcgcatgcgggtgatgcggagcagggcgacggccgcctgaccgcgccgatgcccggcaaggtgatcgcggtgctggtcgagccgggccagaaggtcgaagcgggcacgccgctgatcgtgatggaagcgatgaagatggagcacacgatcggcgcgccgagcgcgggcgtcgtcgcggaagtgctgtacggcgtcggcgaccaggtttcggatggcgcgcagttgctgatgatggcggaaggctgagcggcgccggtttcgcgtatgcgggccggctgccgtggctgccggcccgtaagacaggcgtcgtgatgcgctccacgaccgacaccacgacagattcgcttcgatcgcttcggcaaaaacgaagcaatgcgaatctttcgattgcattacgtcaacctctcgttatcccctccgccgcgacatgtgcgccccttgcgtgcacgcggcgcgcctcctgcacgacaccatcgtgtaacacgtgataattagcatctcgccgtcgacacgaccggtgcgcacccgcgcctgtgtcaggtcgtcacatccacggagagacgttatgcgaaagtcggccctacggcctttcgcggtcgttggcctgatcgcgctgaccgcactcctcggtgcctgcaacgacgacctgaccgcacccgccgcacctgtggcgcagcagaaggccgcctgcggcggcggcgtggtcgccaccgcgcagatgcactgcccgcccggtttcaccgcgcctgcttcctcgcccgcttcctgatcccggctgtttccaccagaaatccaatcaagagcaaccagcatggccacccattcgcgacgcgattttctgaagttctccgccggcctcgccggcgcgaccgccgccaccgcactgcttcccgaatcgatccgcaaggcgctggcgatcgagccgaataccgtgacgggcacgatccaggatgtgcagcacatcgtcgtgttcatgcaggaaaaccgctcgttcgaccactacctcggtcacctgagcggcgtgcgcggctacaacgaccgcttcccggtcacgctgccgaacggcaagccggtgtggttccagccgcggcaggaggacaagacgagcgtgatcgcgccgttccgctacgacacgaccgacccgggcgtcaacgcgcagtgcatcggcggcctgccgcatacgtgggcgacgacgcacggcgcgatcgacaacggccgcgccgaccagtgggcggtgcagaagtccaacatgacgatgggctaccacgtccgcgacgacatcccgttccactacgcgctcgcggatgcgttcacggtgtgcgacaactacttctgctcgattccgggcaacacgcacccgaaccgcatgtacctgatgacgggcatggtcgacccgctcggcacgggcggcggcccgctgctcgacaacaccgactacatcgacaaccagttcgacaagatcaagttgccgcccttcagctggacgacctacccggagcggctcgaacaggccggcatctcgtggcaggtctaccagcagggcaccgggttcgacaacttcaccggcaactacggcacgaacatgctcgcgtgcttcaacaacttcgtgaatgcgccggccggttcgtcgctgcagacgcgcgggatgagcacgcgcccgatcacgcagctgaaggcagacgtgcaggcgaacgcgctgccgcaggtatcgtggctgctgccgcccgccgcgtattcggagcatccgaagttcacgccgctctacggcgcgtattacctgtcgaccattctcgatgcgctgacgtcgaatccagacgtgtggagcaagaccgtcctgctcgtcatgtacgacgagaacgacggcttcttcgatcacgtcgtgccgccgtcggcaccgacgctgccgggctccggcatgagcaccgtggacgtgtcgctcgagcggcacaacgtcgtgacgtcgacgcagacgggtacgtacacggccgacaacctgccgtacggcctcggcccgcgcgtgccgatgttcgtggtctcgccgtggtcgaagggcggcttcgtgtgctcgcaggtcttcgatcacacgtcggtgctgcaattcatcgagaagcgcttcggcgtgatggaaaccaacatctcgccgtggcgccgcgcgatctgcggcgacctgacgtcggcgctcgatttctcgaaatcggatgcgacgctgccgaccctgccgagcacgcaggcgtatgtcgcgcaggcggacctgcagtgttcgcgcgcgtcgtcgcagaccgcaccggccagcaccgcgcagcaggtcgtgacggcacaggagcccggcacgcggccggcgcgtgcgctgccgtacgaattgcacgtgaccggccagctccaggcgcaaggctacgcggtgacgttcgcgaataccggcacgcagggcgcgcatttctgggtctatacgggcgaccccaccgcgatgccgcgccgctacacggtcgaagcgggcaagcagctgaccgacacgtgggcgctcgatgcgagcggcaactacctggtgagcgtgtggggccgaacggctatttccggcgcttcgccggatcggccgtcgcggatgccggcgcgaagcctgaaatcacgccgtgttacgacatggccaacggcgacgtgtacgtgacgatcgccaacgcgggcaccggcacgctcacggtcacggcgaccgatgtcgcgtacggcggcgcaccgcgcacgttgacggttccggcggggcagcgcgtcgaagcgcactgggatctgtcgtgcagcagccactggtacgacctgcagttcgcggtggccgggaacgccggctggacgcgccgcatcgcggggcacgtcgaaaccggcaaggccagcatcaccgacccggccgccgtggcgccgacgaccgcggcgatctgacggcaaaccatgcgtgccggctccgcgccggcgcgcgacgagcgcatgtcagaaacgaaaaggcgccgcgcggcgcctttttcagtcaggtgcgcgaaatcagatggggcgaaaaactgcgtattgatcgccatcgagtttttccaggtaccgggaatcatggagcgtcaggttgaccggctggagaaatttctcgtcggcggcctcgtgttcgttgctggcgcgcgtattgaacaggctcgaagcatttgcggagttcacgagagaatcgaggcgcggtgcgttccagtcgaggtgcccctgagcaagtagaagtgcatgatcccgcattgctgatgggcccagaagtcatgccacatgaatgaatcgggccgccacacggagttgtggctctcgaagtacgatgcgctgctcatcggcatgcactcggggtcgagatgatgatgtatcgcgatcgatagttgagaaactccagcagatcgcgaccgtgggagtggcgcatgtgctcgatgacatcgcccaggatgatcgtgtcgtacgagtcgccggaccgttcgtacagcgtgtcgctgacgccggaaatgatgtcgtcgtagccgttctcgatcaggaacggatgggtctcttcatcacattccagcgccgtgaaacggcaatcgggcacgatcttcttgagcaggcgcccgtatttcccgccccggccccgacatccagaatcctgcccgggttgatcgacttgaccagatgctgcgtgagttgatcgaaggttggccacgaatacccgatctgttccactttgacctcccgtcaaggctggtttgaaaaattgatcgtagcgatgtcacagcgttgctgcgaggtcgttttctgtccaccctggatgccgacaccgtgcggcaacccgggtggcgcggcgggtcgcacgagtatcgcacaaccgtctcgcggacttgcgcgtgcctgcccggcgctgaccatccctgacagtatgcggcgggcactccgctagaatgccgggttgccggcggcgtgcgccgcttgacgcgggcggcgcttcgcgcgctacactgcatccattccatccccatccaacttcccatcccgccgacgatgacatcccctgtcctgaacggcctgcgcatcggtatcacgatcggactgcgtgcccctgacgaaagcctgtggatcaacggcatcaagcagaacgcgctgtttctcgcgaagctgctgatggcgtcgccgcacggctaccgcgtgacgctggtcaacaccaccgacgtaccgctcaccgatgcattgccgtgggatcgcagcgtgtacgacacgcgcgcattcgccgagatgaaagatgcgctcgacgtggtgatcgagctgggcgggcagatcgacggcgagcagacggcctacctgaaggcgcgcggcgcgaagctcgtcagttactgctgcggcgtcgagtacatcaacgcgatggaatcgatgctgttcggccgccggctgtgggattcgctgttcatcaaccgcggttacgacgaggtgtgggcgattccgcagatcgcgccgtcgtcgctgccgttcctgcagtcgctgcgccgctgccccgggcgcgtcgtgccgttcgtgtgggacccgatgttcctgagcgcgcgcgcgcagtcgctgccggagcacggcgaataccggccgcgcagcgagccgggcaagcggctgacggtgatggagccgaaccacgacgtcgtgaagttctgcgtgtatccgatgctgatcatcgacgaagcgtatcgccgcgatccggatgcgatctgcttcacgcacgtgacgaacgccgatcgcctcgcgcacgacagccccgagttcgtgatgctgatgaactacctggacatcgtgcgcgcgggcaaggcgagtttcgtcgggcgcttcgatacgccgctgttcctggccgacctgaccgatatcgtcgtgtcgcaccaatggtcgaacccgctcaactatttctatttcgacgtctgctggcagggctatccgctcgtgcacaacgcgagcctcgcgcccgatctcggctactactatccggacaacgacgtgcagcaaggcgccgatgcgctgctgcgcgcgctgcatacgcacgatgacgactgggaagcgtacacgcggcgccagcgcgacatcctgagccgctatacgtcggcgaatcccgcgctcattgccgaatacgacgccctgctcgcgaacctgatcggcgcatcggctgcataaggcccgattttctcgcggcgcacacgttgcgccgcggcccgccatcgggattgtcccgccctaatgtctgacgaaataatgccgttaaagaaaccgccgaacccgatcggttcgacggttttcgaaggcacgaatttgacggctccgagggaagtccgtcggaaatcattttataggttaacaagtatttaagattgttaaaaatggtttgatcgataatcatcatatgatttaaattgatattatagattaacggttgttcgattctgtttagaaatttaataattcgtttgaaacgggaaaattgagcgctgcgatgatcgaatgacgtgcggcagccgatttgcggcgatgcgcaagccgggccgccagccttcacggcgagtccggcagcgggcgagggcgctgcctagcgggccggtatttatctgattaattgaaggctttcgaatttgcgaggcatgcaaattacgcgggaattgattcgggcaagggtgtttaggtggtttgaataaacaatatccggatcgggtttaggtaatttgcgttagtgtgacctgtcgcacaatcggtatcgcgcatgcgtggtgtattccagtaactgaatatcgttgaaaatatcgaatttgacggcgcgccgaagcgaaaagtacgctcccggaaaagatcgacataacaggatgggccgggtaggcggcggagcacgtcatgatcggtttgctccgcatgtttgttgaggtcgagccgcgatcggcggctcgccatttgccggagcgccggatgaatgcggtcgaagctcgccaggaggcgaatcgggaagcgaatcgtgacgaaatcgatctcgtgttcggcgcccccgacgatcatcccgacctcgcgtcggtacgcagtttcgtggagagccggctcgcgttcgcgcaagagcccgtgtgccgggccgacctgtcgggcggtgtgctgtaccaggaatgcctggcgcgattgcggtggggcgagcgcgatgcgctgccgccggtcgcgttcctgccgcgcctcgaggcgctcgggctgatgcggtggttcgaccggctcgtggtcggccggacgatcgacgcgctgcgcgccgatccggctgccgtctacggctgcaatgtggcggcggcgagcgcggtcgtcgacgatgcgtggctggccatcttcaggcggctcgagcgcgagccgtcggtcgcggcgcggctggtggtcgagatcacggagacggggccgctgaatcccgtcgcgggtcgttcgttcgtgaaccgcttccggcagaccggatgccgcatcgcgatcgacgatttcggggtcggcttcagcgcattgaacaacctggtggtcggcaatcccgacatcgtgaagcttgaccggtcgatcctgtcgatgatcaagcgcaacgcgatcggccgctaccagttccgcaggctgatcgcgttcgcgcatgaaggtgcgcggcacgtcgtcgtcgaaggcgtggagagcgagatcgaccggcagatcatcgtggatgccggcgtcgcctgggcgcagggcatccgattttcatggcggtcgccggccgccgcgtgacggcgcggaaactggtgggtggcgtgcacgacgcacgccggtgtcgggcgtggccggcgcgtggccgggacgaatcgcaaaggggcatgggcatggcggggacgaaggccggaagcggaacgggcacgcaggcagccggtgcgcgcgaactcgtcgcgatcgccgagctggccgacatgctgtggcagctgggcgccgaatcgaccgaagtgccgatcgacgtcgcgccgtatctcgacggactgacaaccattgcgcgccgcatccagcggatgacgccgctcgacgccggcggccgcgaactggccgcgcgccactattacgcgggtgtcatcgcgggcgcgtgcggtgacgattcggcgatcgcgcgcggcgtgtccgacagcctcgtcaagcaatccggcggcaccagccggcgggtcgcgcactgcttcgcggtgctcgcgcggacgggccggcggcatggccgtgtgttcgccgcgcagagcggcgaccgggtgctggtctagcgcctgttcacgccggtagcgggcgccggctcggcgcgatgcgcgcggcccgcgtcgatctcatcttcgcgtagcggcccgacgcacgccaaaccggtcaatccttcccgaatccgccgagcacgaacgccatcgcgcggtcgaccgcgtcgtcccatcggccgacgtgcgcggcgcgcacgatccggacgcccggatagagggcggtgcgcgagccggtttcccagcgcgcgtcggctttcgggctgagcagcagcacggccggcacgccgagcgcgcccgcgagatggacgtgcgcggtgcaggtggtcaccactgcgtcgagcgcgagcatcagcgccgccagatcgctgaaatcgccgatcgcgtgatgcgggaaggtcaccggcaggtccgattgctcggactgcgcggacaggtcgcggttgatgcagtacgcggcgtgaccgtgcagccgcgtcagcggcgcgaggtcgcgcaggctggccgcgcgatggaagcgcgcgtcgctttcgtcgcgcccgcgccagttgagcccgatgcgacgcgtgccggcggcatggccgtcgcgcgacacgcgctcgcgccacgcggccgcatgcccgggcgggcaggacaggtacgcgcccgccgatcctttgggtgccggcgcgtagccgaactgcgcggcgagcaccaggaacgaacaccagtagtcgtgtgcgatctgcgacgtgtcgatccacgcgccgtgcgcgccgatgaattcgatgtgcgggaacgtgtgacgcatcaggcccgtcagcgcgtccggaacgacgacggtcacgctcgtgcagccgagcgtgtcgagcgcatgcaggtagcgtgcgtactggagctgatcgccgacaccgccgtagctgagcaccagcagccgcttgccctgcagcggctggccctggtagagccgctccgtcggcagcccgaactgcgcggccgtcaggacgttttcgctcgcgatggtggcgcgggccgcttcgtcgcgccggccggcgcgcagcagcagcatcgaacgcatcagctcgatgcggccgcgcgtcgcgtcgggcagcgcatccggatcgccgaagcgttcgagcgccgcgagcccggcgtcgggtgccccggcaaagccgtagcacgacgcgagttgcagcgcgatcgcgtcgtcgtcgagcccgcggccgcgcgcgttgccagcggtcgatcgcgtgtccccactcgcagcgcgactcatggtcgagtgcgcggttccagtgcgtttcaggcgcgtcggtgtcggcggctgcgtcgggggcgcatcgacgtcggccggcgacgcgacggcgatcggttcgatcgagatgaccagccgctgcctgtcccagcgcgcgttcggcacgcaaagcaggttcagcgggtccatccggtagaacgtgtagtcgaggccggcaaaggtggcgatgatcggcgcctcgccgactttccagtattcgacccagcaccagggcaggtgcgtctcgatcagacggcgcgcgccgcgcagcgcgtcgatctccatgccttcgatgtcgagcttcaggaaatccagccgcggcaggccgagcgcgtcgagcctgacgaccggcgtcggcgtgccgccttccgcgtgcgcgccgacgagcgatacctggccgaagtcggcatcctgcccgtagtcgacgtcgggcaccttcatcgtgccgttggcgccggcgagccccatgttcagcagatggacgttgtcgagctggttgagcgcgacggtgccgccgagtgcatggaacagcgtgcgctgcggctcgaacgcgtacacgcggccgccgcgtgcatgcaaccggtgggcgatcggcacgcacacgagccccgcattcgcgccaccgtccacggcgatcgcatcgtccggcaactggtcgatcaccttcaggatcgtgtcgagctcatcctggatgtgcggccgcccggtcttgatcaatgcttcggcctggtacgcgcagtgccggttgatgacgaacggaccgtgaatcgaatcgatcacgacgaaattacggacggtctgattcatgggcggtagcaggggcgaatgaggtcagccgagtgcgcggccggcgaacaggtgctggatctgcgtggaatacgcgtggacgttgtgcgcggcgagcgtgtcgacctggtgcaggcagcggcgtgccgcggcggcgtattcgtcgagccgtgcgtcgtgcgtctgcgcggcggtcgcgatcgcacgcgccgcatcgaagatctcgaagtccggatagtaatagccgacgtcgcgcaggaacggcgagttgtgcacgagcgggtagttgccgtacagcgcgtcgtacagcaggtagttgaggccgttttcccagtggtgggacacgacgatgtcggtgtgatgcgcggcccacgcgacgaacggcgcgcgcacgtcggcggtcgccttgccgtcgcgcaccatctcgagcccgagcgcgagatgcttgaaggcgacgttttccttcttgtcgaacgtgttggtcatgtacacgtgctcgacgagctccggatgctcgacgtagcacgcgttggcggcgagcatcggcacgatcgagcttttcacgacgttcaggttcggctcgaaaacgcgatgcgtttcgcggggccgtggttccgataaccgaagcgcgccttcagttcaggatcggcgtcgaggctgcgctcgatgaaatacggcgaccagatgtgcggcagctcgatcaccggcgcgcggtacacggcctggaaatacgcggcgcacgtgtgcatgtgctgcgggttggtccagatctcgtcgaactgcacgcggtgcgggttcggccgccacgggttcttctcgaagttgatcgtctcgacggcgatcacgtagtcgttgccgaagcggtacgacacgcacttgccgccgcgtcggcgcacggcgtcggtgtgcgtcgagtcgacgaacgcgttcatctcgatcagcaggtcggtctggtggacgacggcggacagcggccgcagcgcgtcgccgaacgcgtccatcatcagcgcctgcggatactcggtcacgccttcgtcgtgcgcgagccagacctcgccgatcagcggcgactgcttcagcagcatgtacaggtacacgcagtgctggttcgcgccgttgtaccagatcgactgcgtcgagtcgcgctgcacgttcatcgttatcgcgacattgagtttcatgacggctccgtggtgcgggcgttgctcgggttacggcgtgtagttttgcgacgagcgcggcacatagccggtcaggcgccagtggccgtcatcctcgcggcgaaagctcagcttctcgaacatggtcgcgccgctcgtcagcgtcgtcgcgtaatcgacgttcgcgtagagcccgtcgggtgtcgtcgacgcgttggtgtagcggatgcgcgtgatctgcgcccagccgcgatgacgcaccgtgccgaccgactggcgcgcgcgctgcatgtccgacgcgaactggttctgcttgatgcgcgccttcacgaacgcggcggcatcggtccacacggcgttgtactggccggcgtcgagctgcttgaacacggcgtccgagtcgcggagcagcgcgtcggccgattcgccgtcggcttgcgcatgcgcgccgatcgcgatcgatgcgacggcgcagccgatcagccatttggcgcgggtgaggggcgtgcgtgcggtcatgtccgagtccggaaaagggcggtgcgtcacgcgtcgcgataaagggtggcgatcgcgtccgtataggcggcgacgttctcggggttgtagatgctcacggagctgagcacgtgcttcgactgctcgcggtacgcttccaggttcgcgtcgtgctcggcgaacgccttcagcaacgcgcggccgccggcctggcagtcgaagtccggatagaaatacccggccttgccgaggaacggcgagttgtggatcagcgggtagtcgccgtacagcagctcgtagtacaggtagttctgcgcgttttcccacgtgtgcgacaccaccgcgtcgccgaatgcggccatgaactcgtacaccgcgtagcggctctcgaacgtcgtgactccgtggttcacgatgtcgaggctcttcgcgaaatggacgaacgtcgcatgttccttcaggtgcagcgtgttgcatacgcgcacgaactcgaggaaatccggtttcgcgcgatacgcctcctcggtcaccagcatcgggatgacgctcgtcttcaccatgcagatgttcggctcgaacatcgtcacgcgccagcgcggcttgccgggttcatagccgaacgacagcccggcaccgagcgtcgcgcgcgccttgtcgaacagcatcgggtgccagatgtgcggaacgatcgtgacgggcgcgcgcaggcccgtctggtaatagtgcaggcacgagcgctcgaattcgggaatcgtccacacggcatcgtacggcgcgcccgagaacaggaaacccgacggcttgttgaacatcgcgcgctcgatgtcgatcacgtagtcgttgccgacccgcatcgtgacgaccttgccgccgcgctcgcggaacgcgcgcaggtaatccgcgccgaactgcgcgctcatttcgatcagtacgtcgcagcgctgcagtgcttcgtccatcgacaggagcggcacgtcccattcgccgagcatcatctgcggatcggcgacctgttcgccgccgttcaccatcacggcttccgcgacgagcggcgactggcgcagcagcaggatcagcagcaggcagttctggaagatgccgttttcccacagcgactggccggcgccgcgcacgaacagcgacacgccgacgacgagacgcttgccctcgccgggcgcttgacgggcattggagtccgacatgcgtattctccggttcaggcgaccagacgcgagacgaacgcgtcgaggttcgcggggttgtcgatcgagaccgactgcagcagccggccggccttcgcgcggtagtcgtcgaggcgttcgtcgtggtgcagccacgcgtcgagcagcgcacggccgcccgcggcggaatcgaagtccgggtagtaataaccggcgtcgccgatcagcgtcgagttgtggatcagcggatagccgccgtacagcacgtcgtaatacagatagttctgcccgttttcccagtggtgcgacacgaccgcatccgcgtggcgcgccatgaaacccggcaggtcgaggcgaggctcgaaggtcgccttgtgctggcgcacgagatcgaggctgttcgcgaagtgcacgaaggtcggatgctccttcatgtgcaacgagttcacgacgaacatgtgctgaaccgcgtccggacgcgcacggtagaacgcgtcgcacgcgagcatcggatagtggcaggacttggcgaccgagatgttcggctcgagcatcgcgaggtaccacgggcggcggccgggccgatagccgaacgtcgcgccttccgcggcgagcgcggcgatgcgccgatcgaggaagtacggcgaccagatgtgcggcatcaggtggacgggcgcgcgcaggatggtccgcagcatcggcgccgcggtcttgtcgtattgcggcagcagccagacttcgtcgaacggtgcgccgttgaagacgtgtcccgacggcttcccgaagatcggggtttcgcacaggccggcgtacacgtgcccgcagaagaacgcggcgattttcttgccgagcgccttcatgtgtcggagccactccaccggcagctgcgcgcccatttcgatcacgacgtcgagttcgtgcgtgacgtcggagggtttcacgagcgggatgtcgaggccgtcgagttcgaggccggccggcagcgcgttggcgtcgccgccgttcaggaagtagaccgggccgacgcgatccgagcgcttgagcatcatcgcgaggaacgcgatgttctggtggatgccgttttcccagatcgcctggccgtcgcgcgcaaacagcgagatgccgaccgccggccgttgcttgcgggtgccgcccgaggcggcttcattgatgtccgtcaccggttggtttcctctgcggcgtcgtgcgtccgggcatcgcgtcgagcgtctggcctggaagcggcgcgccgtggattgtcatggttgcatttgcgccggtgcgccgcggcgggcgaatcgggcgacctggttcgcgagggcggcagccggtttccggcgtgtcatcgggcacgcctggcacggcgcgtgattcggacaggttgccccggcgactgtctgcggcgattgtggcacggaaaccgccggttttggcgggacgtgacgaactttgacatagccgccggtcaaggagcagggcgccggcgaagcggcgcccggggcgtccggcgggggcgggtgcgggtccggcgcggcgctgacggccggccggatcggggcgccgcgcgcggcggcccgctcagtgctgcaggcggatttcgacgcggcggttgctggcgcggccttcaggcgtcgcgttcgacgcgaccgggtcggccttgccgcgacccgagaccgtcagcgaatcggtcttcaggccgtgtgccttcagataggccgcgacggattcggcgcggcgcttcgacagcgcgagattgtagtcgtcgctgcccaccgaatccgtaaagccggtgacgctcacctgcgagtacgtgtggtcggcgcgctcgctcagcaaccggtcgagcgattcgcgcgcggtcggggcgagcgtcgcgtggtcggtggcgaacagcgcgtcgcccgacaggttgacctgttcgacgacggctgccgccggcgcggcggcctgcgccgcttgggccggcgccgcgccgcactggaacacgagcgtcgcgggatcggacttgtcgcgcagcgcgcgggccgaatcgacggcgcgcacgggctcttcgccgcagatcttgcgggcggccttcatgcaggtttccgggcccgacagcaggccgtggcagtccacctggaacgtgcgcacgccgtcgcgcggctgcagttcggaggcgctgaaggtcgggccggatgcggtcgagcacgcggcgagggccgtagcggaaagtgcgagcgcaagagcgagtttgttcacggttacatcctcaaaacttgggttgactgaagcccgccacgggttgcgcggcgggctcgtccggccgtcggggccgccgcaggccgtccggctggcgagccgggcggcctggcggcgcgacgcgttacttccactggtacagcatgccggcgccgatcaccttctgaccgccgctgaagccgccgttgatcgacgccttcaggttctcggtaatgcgcgcctgcatgttgaccgccatcgccttctggccgaggaaggtcgacgtgcccacacccatcccgaagttggcgtcgcgatcgagctgcgggatcgacgccatcgcgccgacggccgcgataccctgcttcgccatctggtcggtctgctgcagttgcgaacccagcgagttgatctgcgcctgctggcccgacagtgccgtcgacagcgtcgtctgcacctgcgtcagctggttcacgttcaccgcgtcggtgccttgcgtacccggcgcgacgttcgtgatctggcgctgctgctggtcgttgccgaccgacaccacgttcgagcgaccgccgtcgttcgaattcgcgccgatcgccaccgagttcgaacccgcggtgacggtcgggacgtcggtgcccttgccgttcatgtcggccgcgatgccgttgttgttggcggcgcgcgtcgtgttgttgttgatcgacgtcgacagctggttcaactgattgttgatgttcgtcacgccggtcgacagcgaggccacgttgctgttcgtcgtgctcaggccggtggacagcgaaccgatgcccgtcgaggtcgacgtcgacagcgagttgacgttgctgttcgtcgtgctcaggccggtcgacagcgagttgatcgcggtcgaggtcgacgtggacagcgaggccacgttgctgttcgtcgtgctcaggcccgtcgacagcgagttgatgccggtcgacagcgatgcgacgttcgatgcggtggacgtcgacagcgcgttgaccgcgttgttcgtcgcgttgagctggctgccgttgatcgcgtccgtgctgctggccgagatccggccggcggcgacgttcgtgatctggcgttccgcacccggtgcgccgacgctcaccacgccgaccggcgagctgcccgcgaagaagtacgtgacgccgccgatcgtggcgctggaggtgccgacggccgcggccgtgaccgagttcgcgccgagtgcgatcgagttggcgacgttggcttgcgcgttcgtgccgaaggcgagcgcatcggcggccgtggccttggcagccgagccgtaggcctgcgcaccgacggcgctggccgtcgactggttgcccagcgcgatcgtgttgtccgcggtggcctggttcgagctgccgagggcgagtgcgctggcaccggttgcggtgttcgcgttgccgagcgccactgcgccgttgccggtcgccgtgtcgttcgcgcccagtgcgaccgcgccggtacccgtcgcgatgctcgggtcgccgatcgcgacggcgccgtcgccggttgccgtgttgccggagccgatcgacacggccttgccgcccgtggccgatgcgttctggccgatcgcgaccgcgcctgccgactgcgcgttcgaaccgtcgccgactgccacgctgctcgcgcctgccgcgctggcgttcacgccggcggcgagtgcgttggtgccggtggcgcccgtgttgtcgtagttggcctgctgcgtgccgttgtcgttgacgctgtagtagtgcgtcttcgcggcgttgatcgcggtcgaggtcgaagtcgacagcgacgacaccgagctgttcgtgctgctcaggccggtggacagcgagccgatgccggtcgacgtcgacgtggacagcgacaggatcgtgctgtccgtgctgctcaggccggtggacagcgagctgatgccggtcgaggtcgacgtggacagcgacgtgatcgagctggtggccgaggagaggccggtcgacgtggaggtcgacagcgagctgatcgagctgttcgccgaggacaggcccgtcgaggtcgaggtcgacagcgacgacaccgagctgttcgtgctgctcaggccggtggacagcgaactgatgccggtcgaggtcgacgtggacagcgaggtgatcgagctgttcgccgaggagaggcccgtcgaggtcgaggtcgacagcgacgacaccgagctgttcgtgctgctcaggccagtggacaacgagctgatgccggtcgaggtcgacgtggacagcgacgtgatcgagctgttcgccgacgagaggccagtcgacgtggaagtcgacagcgaggtgatcgagctgttggccgaggacaggccggtcgaggtcgaggtcgacagcgaatcgatcgagctagtcgcggacgacaagcccgtcgaggtcgaggtcgacaacgaggtgatcgagctgttcgccgacgacagacccgtcgacgtcgaagtcgacagcgaggtgatcgagctattcgccgacgagaggccggtcgacgtcgaagtcgacagcgacgtgatcgagctgtttgccgacgagaggcccgtcgacgtggaggtcgacagcgaggtgaccgagctattggtcgacgagaggccggtcgacagcgagccgatcgagctggtggccgacgacagacccgtcgaggtcgaagtcgacagcgacgtgatcgagctgttagccgacgacagaccggtcgaggtcgaagtcgacaacgagtcgatcgagctgttggccgacgacagacccgtcgaggtcgaagtcgacagcgaatcgatcgagctattcgcggacgacagaccggtcgaggtcgaggtcgacagcgacgtgatcgagctgttagccgacgacaggcccgtcgaggtcgaagtcgagagcgacgtgatcgagctgttagccgacgacaaaccggtcgaggtcgaggtcgacagcgacgtgatcgagctgttagccgacgacaggccggtcgacgtggaagtcgacagcgaggtgatcgagctgttggccgacgacagaccggtcgacgtcgaagtcgacagcgaggtgatcgagctgttggccgacgacagacccgtcgaggtcgaggtcgagagcgacgtgatcgagctgttggccgacgagaggccggtcgacgtcgaagtcgacagcgaggtgatcgagctgttggccgacgagaggccggtcgaggtcgaagtcgacaacgaggtgatcgagctgttggccgacgagaggccggtcgaggtcgaggtcgacagcgaatcgatcgagctgttggccgacgagaggccggtcgaggtcgaggtcgacagcgaatcgatcgagctgttggccgacgacaggccggtcgaggtcgaagtcgacagggacgtgatcgagctattagccgacgacagacccgtcgaggtcgacgtggacaacgaggtgatcgagctgttggccgacgacaggccggtcgaggtcgaggtcgacagcgacgtgatcgagctgttggccgacgacaggccggtcgaggtcgaagtcgaaagcgacgtgatcgagctgttagccgacgagaggcccgtcgaggtcgaggtcgacagcgaatcgatcgagctgttagccgacgacagaccggtcgaggtcgaggtcgagagcgaagtgatcgagctgttggccgacgacagacccgtcgaggtcgaggtcgagagcgaagtgatcgagctgttggccgaggagaggccggtcgaggtcgaagtcgacagcgacgtgatcgagctgttggccgaggacagacccgtcgaggtcgaggtcgagagcgaagtgatcgagctgttagccgacgacagacccgtcgaggtcgaggtcgacaacgaggtgatcgagctgttggccgacgacagaccggtcgacgtcgaagtcgacagcgacgtgatcgagctgttggccgacgagaggcccgtcgaggtcgaagtcgacagcgacgtgatcgagctgttagccgacgagaggcccgtcgaggtcgaggtcgagagcgacgtgatcgaactgttggccgacgacaggccggtcgaggtcgaagtcgacagggacgtgatcgagctgttggccgacgacagaccagtcgacgtcgaagtcgagagcgacgtgatcgagctgttagccgacgacagaccggtcgaggtcgaggtcgagagcgacgtgatcgagctgttagccgacgacaggcccgtcgaggtcgaggtcgacagcgaagtgatcgagctgttggccgaggacagacccgtcgaggtcgaggtcgacagcgaatcgatcgagctgttggccgacgacaagccagtcgaggtcgaggtcgacagggaggtgatcgagctgttggccgacgacaggccggtcgaggtcgaagtcgacagggaagtgatcgagctattagccgacgacagacccgtcgaggtcgaagtcgacagcgaatcgatcgagctattcgcggacgacagaccggtcgaggtcgaggtcgacagcgacgtgatcgagctgttagccgacgacaggccggtcgacgtggaagtcgacagcgaggtgatcgagctgttggccgacgacagaccggtcgacgtcgaagtcgacagcgaggtgatcgagctgttggccgacgacagaccggtcgacgtcgaagtcgacagcgacgtgatcgaactgttggccgacgacagaccggtcgacgtcgaagtcgacagcgacgtgatcgagctgttagccgacgacagacccgtcgacgtggaagtcgacagcgaggtgatcgagctgttggccgacgacagacccgtcgaggtcgaagtcgacagcgacgaaatggcactggtcgcggtaccgacctgttgggcgacagaataaagctggctaccgttgatcgcgtcggtactggtcgacgttacctggccggcggcgacattggtgatttgccgctcgttgttggcgctgccgacgctaacggtgccaaccggcttggtgcctgcgaatccgccgaacgtgacgccgtcgacggttgcgctgctcgtgccgacggccgcggtgtcggccttcgagccggcgcccagcgcgacggaattgttcgtgctggcgatggcgccgctgccgatggcgacggcgtcggtgcccgtcgcggtgctgtcggcgccggttgagttcgcgtggaagtacttgatgccctggctgttgatgctgtcgattgccgagccgacgctgttggcggtcgacgtcgtgccgttcgcgttgtatgtggtgtacgacggggccgagaccttgccggttgtcgggtcatacgtcgagccaccgccaagtgccgaggccgtgctgctaccgaggttgtccgtcttcgtcgagaccgtgctcaagccggtggacagcgagccgatcgagctggtggccgacgacaggccggtcgaggtcgacgtcgacagcgaagtgatcgagctgttggccgacgagaggcccgtcgacgtggaggacgacagcgaagtgaccgagctattggtcgacgagaggccggtcgagagcgaaccgatcgagctgttggccgacgacagacccgtcgacgtggaggacgaaagcgacgtgaccgagctattggtcgacgagagaccggtcgagagcgagccgatcgagctggtggctgacgacaagccagtcgaggtcgaagtcgacagggacgtgatcgagctattagccgacgacagccccgtcgacgtggaggacgacagcgaagtgaccgagctgttcgtcgacgagagaccggtcgacagcgaaccgatcgagctggtggccgacgacaggccggtcgaggtcgaagtcgacagcgacgtgatcgaactgttggccgacgacagaccggtcgacgtggaggacgaaagcgacgtgaccgagctattggtcgacgagaggccggtcgagagcgaaccgattgagctgttggccgacgacagacccgtcgacgtggaggacgacagcgaagtgaccgagctgttcgtcgacgagagaccggtcgagagcgaaccgatcgagctggtggccgacgacagacccgtcgacgtggaggacgaaagcgaagtgaccgagctattggtcgacgagagaccggtcgacagcgagccgatcgagctggtggccgacgacaggcccgtcgacgtggaggacgaaagcgaagtgaccgagctattggtcgacgagagaccggtcgacagcgagccgatcgagctgttggccgacgacagacccgtcgacgtggaggacgaaagcgacgtgaccgagctcttggtcgacgagagaccggtcgacagcgaaccgatcgagctgttggccgacgacagaccggtcgacgtggaggtcgagagcgacgtgatcgagctattcgccgacgacaagccggtcgaagccgacgtcgacaggctcgtgatgctcgacgtcgtcgtgctcgcgaccgagtagagctggctaccgttgatcgcatcggtgctggtcgacgtgacgagacccgccgcgacgttctggatgcgacgctcgttgcccgccgtacccacgctgacgacgccgttggcggcgcttgcgcccgcaaagttaccgaacgtctggccaccgatcgtggcggagctgaccgaaccggtgccgcccgttgccgtgtccgccgcaccaatcgtcgccgagttgttgccaagggcgacggagtttgcaacgttggccgtcgacaggtagccgagcgccatcgcgttgccggcggaagcggtcgattgatagcccatcgcgaccgcattgccgttgccgctggccgtcgcaaacgagccgatcgaaatgttgccggcttgagaagcattggattgctggccgattgcaacgctctggagcgcactcgcagtggccacgcccagcgcaacgctgccgccgccggcagcgctggcgttgacgccgatcgcggttgcatagttcgccgtcgcggaactcccgttcccgaaagcggaggcaggcgccgaagtcccgcccgcatacgacgaggcaccgattgcgctcgaacccgcataggtcgccttggcgccgctgccgataccgaccgaacccgtccccgtcacgctgttgccactgcccagcgcaaccgcaccggtgccgttcgccgagttgccgttgccgagcgcgaccgcgcccgtgccgttcgccgagttgctggtgccgagcgcgaccgcgccgtcgccgctggccgtttgcgcgcggccgattgccaccgcgccgccgctcgcgctaccactgttggccgtcgtacccgacgaaccgatcgcgacgttctggccggttgcgccggagacgatgccgtcgccctgagcgatgccgtacgcgccgttgacggtcgcgccgcggccgagtgcgatccccgacgtggcggccgatgcgacggatgactggccgccgaccgcgatgctgtccgaagcggccgactgcgcgcccttcgttgcgttgctgccgattgcgatcgagcccgcacccgatgcgatggtcgagtttgcctgcgacagcggcgtcgtaccgttgccgcccgcgccgccgattgcgacggagttcagcgcggctgccgtcgagccgaagccgagggcggtcgcgcccgcgccgctcgcagtagattcgaggccagcggcggtaccccacaaggcggccgagctgaggaagcccatcgcggtaccgcctttgcccgtgacttgggaataagtaccgtaaacggtcgctgcgagattgttgttgccggatgcgttgcagccggtcacggttgaccacgtgcccgagccgtcggtcggatacgagttggtatcgcccattgatatacgcccggcggtcgcagtgccactgccggacgtacagctcgataccgtgaactgcccgaatccgttgactgttccggggatataagtcgatgcgcttgcaagtgacggcaggctgatcgccagggccgcgactgcggcgaccaagacagccgacttgttcggcttgccccgtgccgaatcgtgttcggatgcagcgacccaggcgccgagggcttcgttccagatcgagcggtatgtgcggttcatgtcctgctacctccaaatgtgcacgccacacaccggtctcttttgttagaggaatgctccgtgcgctcgcgcgaatctcaaaattgatgggcggagtttattggaggaggatttttcagattgctaaaaagtgataaataccgggtttgaaaagttaaaggatggttaataggccgtgttttgatgcgtcaatgaggaatgaatttgtaagatgtaagaatgaaaaatgtaggatcgagctccctcggcatgcatggcattttatctataaaaatcaatgagttatgtttgttttgtgcggtgggttacagatgcttttggagcaaaagtaaggaaagtgaaatagcaaacgtttgcgagcgaggcattcctttctaatttgtaatgtttggcgtcgtgttttgcgataatgggatttccacctcgttaatttgttaattcgagattttggtttctatttattattgatttactggattatctttaaatcaatttaattcaaaattaagaatgtcgggctgtgctgatatgcgcatttcgttcgctgcgatggcccgtgtgacgggcgttccgggcgggatggcgcgtcgaatttgtaaaaagtgctacagggcgatggtcagggccgtcgtcattcgtatttcgaatttgtcctattgactatttcgttgatgttgacattcgtgtggggtttgacgacgaggcgagcccgtccgggaggcattacccgctaccggtttgcgcgtgctggcggcaggttgttaaagccgctggccgacgccctgaattgtcaaatcctgggtgtgacaatttgtccgcgcgcctcgaagcgccgaagaaaaacggcgtgagcgaatgtgtcgagggcgccacatctggcaggtggatgcaggccggtgaggtttcacaccgcatgcgatgtagcgatgtggcggcgtcgagcgggcggcgggccgggcagcccgagcgatgcggctcgccatgcaaagtgtgacgaacgcgcatcgaggtgtgaacgggacgcggggcacggagcagaacggatacgtcgatcacagcgtattgcgctgctgcgcgcccggatgcggacgatgcgattgccaccggccggttccggccggcattcagccggcccgacgtgatgatggccgaggcccggttgccaggatgttcgaccgggcaaccgggcccttgcccggatcggttgcgttacttcttgagaaaccgcagcgcgagccgtgccatacgcggcacgaacaacgggcgcagcaggcgcttgtcgtaaccggccatccgccgatcgttctcggcgagacacagttcgatcagctcgcgcggcttgagcgcttcgccgatgtcggcggtgttcgtcgccgggaagttcgcgtcgcgcgcgacgccgtcggcgtcgatcccgcgcgcgatgccgatgcgctcgcggatcaaatgtacccacacggccgcgacccgcgcgaagaaccagggccggcgccaccacgtcaggctgcgccagtaccacgcgtaccagttcacgaagaacaggatgtggcggccttcttcctggatcacgggctcgaaggtgtcgacgagttcgggcgggaaatacccggagcgctgcgcggagcggaacaggccgaacgcgaagaagctgtcgatgcattcgctgaagcccgtgaccatccacgaccactcgggatccttcggcgccgggtagggtggctcgggggcgagccggatgccgtatgcctcgacgagcttcgacagcacgaccttgtggcgcgcttcctcgccgccgtccatctcgagcgcgcggcgcagcagcggatcgccgaccgtcgccgcataggtcgcgacgcggatcgatgcacgaccttcggtttgcaccgcgatgtcccagatcggcagcgacgtgagccgcttgagctcggcgggcttgagcgccggccagtcgatgaccgccggcttgtacgggttgtgtgtgtcgagcagcatgcggcagaacatctgcatgtgcgcatcggaaccgatccggaccggaccttgcctctcgaaggtccagttgcgcattgcgtgatctgcggctgcgtgctgttcctgcagcgtgtcactcatggctattgttgtgcgattacggatcgaaagattcttgcatagcttccgtaattgcgtattttcgagcggccatgcgcacgccggccaggcgtgcgtcacgcgtgcgtgtcgacccagaggcggccccagcgggacgcgtaggcaagcgcgtgttcttcctcgaagaagaaatcgatcgcgtcgaacgagacggagcgcggcgacgggccgctgcttgccttcgcgatcgtcaggttggcggcgaacagcccgttcggcaaccgggcggcagcgggggcgacttcgtagcccttgtagcggatcgtacggttcatggcgtgcgcggagagagttcggatgttcagcgtacgaaaacccgccggccgcgtgaaccaatctttcggccaatgcaaatcacgcggcgggccgaatcgttatcggcgcggggtacgggaaagggcaaccgggggcagcgtcggcgtgcacggcgcgcggccgttcgtccgaatgcaccgcccgcgccggcgaacagggtcgtccgggcgcgggcggtgaaaggcggggaattactggttggcgatcttcagcacaggcgcgagcgcatcgaccgacgccgcatgcgaggccgcgcgatgcgacgcgaacgcgagcgcgaactcggccgcttgcgtgccgaccgtctcgagctgggcgacgaccttcgggtccgagcagctgtcggcgctgtcgaagcgcgtttcgagcgtgttcacggtcgcgccgaacggcgtcggccagccgcgcagcgcatgcacgatcgaacgcagcgacgtcagcacggtgcccgccgcctgccagccgtacgcggtgacgatcaggccgaccgcgcgtccgtcgagatagggccgatcgtccgcacgcagttcctcgagcgtatcgagcgcgttcttcacgaggccggagacgccgccgtgatagccgggcgtcgcgatgatgatcgcgtcggcctggcgcacggcgtcgatcagttcgcgctgcgcgtcggtcagcgttttgtgttcgggggcgtagtgcggcagcgtatgcaggaacgggccgtcgaacaggcgcgtgcgtgcgccggctgcctgcgcgccgcgcaacgcgaacgacagcgcgcgttcggtcgacgacgctgcccgggtggtaccgccaatgccgacgacgaacgggcggcggtgttgatcgaatgcagtcaaggggcgctccttggggatggcttgcccggctaagcacaggcttaaaaaccagatggtaacgaccccgccgccactctgaaaacgacttttcgttctatcgatatgccgggaggcacgggcaatcgtgcgcgcggtcggacggatcgatagcagaaatgcttggttgggctggccggccgcggtcgataagatgggcccgtctcctccatgatgtctctactgacatgggttggccccgccgcgcggatgcaggcggggctttttcgtcccggtcaggaaaagggtgcgatgcgccgggccgtggcccgtcagtcgaacaccggccggaagaagctgcgctcgtagctgacgatgcagcgcgtttcctcggcgtagcggaacgcggcctggcaggccggatcctccatcgagcgctcgcggtagcgttcgtattcggcgaggctcgggaacgagaacatcgcgagcgcaatgttgtttgccccttcggacggcaggaagtagccgtgatgcgtgccgccgaactgctcgacgagcggaatccacatcttgccgtaggtttcgaactggtcgagcttgtacggatcgatgacgtagcgaaggaagcaggtgatcatgggcgcgcctggagcaaagagaacccggcgagtgtggatggcgctgcagcatgtgtcaacggcgcgccggcgatcgacgccgtcgcgctcgatgcattgcttgcgtgcgcaacgatcggtgtgccgtcatgcgttcgcaatgacgcacgcgccgccgcggcgtgcaccgtcgcaaccgtttctcccgcacgcacgtccccaaacttttacgacatttttcttgcgggggccatcggcgcgctcatagacttcgggcatcccaaccacggagcatggcaatgtcgataccctggaacgcgatcgccgaacacacgcctgccgcgccgccttccgcgtgcgccgaccgggtgatcgtgcggcgtttcgatccggccttcgacagctatgcccaactcacgccgatgctgcatcgcgcgttcgcgcggctcggcgcgatggggctcaactgtacgtgtgtcgaccaggacgaggccgtcacgcgccgtcgcgcggaagcgggcgagtgctacgtcgccgtgtgcggcggacgcgtgatcggcacggccacgctgtatgcgaccgatccgtcgtcggcctgcccgctgtaccggcgcgaaggcgtcgcgagcgtgcggcaggtggcggtggacccggattgccagagccgcgggatcggcgcgttgctgctgtcgttcgccgagcggtgggccgcgttgcgcggctacacgctgctcgcgctcgacacgccgcatcccgcttcgcacctgctcgcgttctacggctcgcagggtttcgacgtcgtcgacgtgatgcgcttcgacggcaagcgctacgacagcgcgatcctctgcaagcggcccgtcgcgcatgtcgtgcgccgggtgtcgtcggcatcgccggcgtcgcgaatggccgcgcgcatggcggccgtgcggcgtgttgctcatgcgttgccgtcgcgcgtggccgcgctggtccggcgcgatcggtacgtgcgacgtggcgcaggctgggcggcgcgacgcgcggccggtgccgcgagttgccgctcgtcgccgtggcgtccgcgccagcacgggcgctacaccttcggctgaacgccgtgctccggttcctgctcctgttttgccgcgtaaacgccggatgagcggagtgtggcgctcccgctcgtgtacggccctcgagacaccccgccgcgccgcggcgaaacggacgtttacgcgctttttatgccctgacgcgatccttcatgagatggccgcaccgatccgcacgttggtggccggatcggacaggttcttcacttgcgcgacgagattgcgttcggcggcgggccgcacctgcatcaacccgcgtgcgccggccacactgaccgcgcggcgatcgaagcccggctcggccgcgccgcatcactcgtcgcggccgctcgactcgccgccgcctttcgcgaggcgccacgcgatcgtgccgagcacgccgatcgcgacgaccagcgcgccccacagcacgtagcggcgcggtgcgtccgtgtcggcggccggcgccggcgtgaccgccgataccggcaacgccgcgccgacgcgcgcgggccgcacttcggggccatgccgaccagcagcgcgtcacggccgacggccgacgacacgagcgacgcgtcgccgacgccgagcgtaaacggcggtgcgccgcgcgccacgaaagtcagcgcggccggatgccagccgatcgcgacggccggctggccgccgccgaatccgccgttgcgcatgtcgacgacgatccgccacgtgcgatccgtattcgccgcgaactcgagcggcggattgcgctgctcgccggccttgccctgcagccggaacagcacggcgcccgcgacgtcgcgccacggcgcctgcgcgtcggcgcggctctgcagcgtcgcgcgcgcgacggtattcggttgcggcaggtcgatgcgcacgcggtcgaccggatacgcgccgtcggtgtcgaacaggtactcgccgggcgtgccgccggcccgcacgcgcacggcgtcgcgccattggcgcggcacggacgcggtgtcggttccgcgcacatcgcgcgggtgcgtctcgacgtcgatcgacgcgatcgcgggcgcgccgtcgagccagtcgagccgcaggtagcgcggcgtcgcgccttcgagtgcgatgcgctcctgcacgagcatgtcgtcgccgtggccgactttcagcaactgcgtgctgccgagcgagcgccagctgcgcaggtcgtcgctggcttcgacggcgacacgcccctggtagctgtcgtcgcctacgtgtacgagcagcgcgtcgatgtcgccgtccgcgtgcgacaggtcgacgagatccgcgccgtgctttgcgcgtgccggtgcggcgacgcccgcgcgcagcgcgccgtccgggccgaccgtcacgccgagcggcgcgctgccgttgtcggcgcgggcgggcggcagcgggaaccagtgcaccggcgtgcgcgccggcggtacggcgggcgcggcggccgcaggcgcgtcgagcgaatacggcaccggctcgcccgcgccgttgaagatgcgcacgtcgccgagatcgtcgcgccggctcgccgcataaaccggctgcggcacggtgagctggtaatacgcggcggtgccgtcgaggtcgagcgagaagcgctgcgcgggcgggccgtcggccgccgcgagcgacgcgagcaggctcagcccgagcagcgcggcgagtcgtttcattgcaggccgtcctgttgcgcggcggccttcggcggcagcggcgagaaatagccgatcaacagcagcagcacgccgatgccgatgaacgacacgatgcgctcgatgccggtcacgtgcgacaggtcgaacaggaacagcttgacgaccgtgagcgcgagcaatgcggcgccgacgaaccacagtggacgcagcccgcggcgcgtggcccagatcgtgatcgcgagcgcacagagcgtccagtacacggacaccgacgcctgcacgagcgtcgattccgccatcgcgccgagttcgtacggcacgccggcccagtgatgcagcgtgcgcagcaggatcgcgttcagccacaggaacgcggtcgcccccgccgcgctcagcagctcgacgcgatggttgccgaacgaccagccgagcttgcgtgcgcgcacgaaccacgacgcggcgagcgcatagacgaccacgagcacgaggtcgagcggattgaagagcggcacgcgcgcccagcttccgccgtcctgcgtgaagttcgcgtagaaggtccacgcccacatcacgatgatgagcggcagcgacgcgagcgcgcacacgcgggcgatgccgtcgcggcgcgtcagccacatcccggcgaacgcgaacaggctccagccgaccatgaacacctgctggatgccgaacgacgacagcacggtgtcgatgtcgtaggccatgtggaagcggtgatgcagcgtgcgcagcatcagcgcgttgaaccacaggaacacggtggcgatcgcggcgtagtcgacgatgtgcggatgccatgcgatgccgagcgcgcgcaggcggcgcagccatacggtgaacgcgacgaacaccaggcactgcgcgatgtcgagcgggttgagcagcgggagccagaagagcggcgccgcgttgccgtcgctgatcgcgctggcgatgctccacagccacagcagcgcggcgagcggtgccgcgccccacacctggtaagcacgcgggaacgccgcgacgggccagcgcagacgcgagccggggcccgacaccagcaggagcagcacaccgaagccgtaggcccacgcgctccagctccatgcgccttcaggcacgaacgcgcgcaggcgccagaaaccttcgagcgacagcagcccgcacagggtccagaacgtcagcgtgtgcagcggcgcgatgatgcctgcggcgacggcttgcgcgaggccgggtgcggtgccgggcgtcgcgtcttccgcgggatcggcgcttgccgtgccgcgcgactggcgccacagcagtgcaaggccggcgccgacggcgacaggccacgcgaacgcgcccatccccgacagcggcgcttcatgcgcatcgaacgcacgcagcgcgagcagtgccagcacgggcgtcagcgcgagcgcgggccattcggcgagcggccacgccagccggcggcgcgcgacatgcgcgagccatgcggtgccggccgcgaacagcgcggtcgaatcgacgacgaagcggtcggcatgcaggtcgacgtgacggctcgcgtagacgaggatctcgtgcagcccgccgcttatccaccacagcagtccccacgcggctgccgcggcgccgatctcgggcatccacgcacgccacgcgcgcgcttccgcgcgcccgtgcagccaccagccggtgaacaggccggcgagcgcgatcagcagcatcgcgatgtaggggctgttgagcacgggaagcgcggtggcgtcggccggcccgagcaggctcgtgaagaacgcgccggccgcggccagctgcatcagcagcccgaagccgaaccgcagcatgcgcttctcgcgcacgccgagccagacgacggccgcgccttcgatcgcccacgcggcgctggtcgtcgggccggagaacgcgagcggcacggccagcgtcgcgaagatcaccgcgagcgcgagcgtggattcgaacagcagcgcgaggcggtcgcggcgccgcgcgagccatgcggtgacgacgacgtagaacgccgacagcgcgacggcgctccacgcgagcccgaacggcatgtccttcacgagcgacgcctgcagtgcggtcgcgacgatcggcgtgccgaacacgagcgtgccgtcgacgtagtgccgcagcgcgagctcgcgcttcaccgcatacagcaatgcgatgccgacgtacatcaggaagaacaggatcaggaacggttcggtgctcgcgaacagcgcggggcgataggccgtcacgccccacgcggagccgatcgtgaacgtgaacgcgaagccgagcaggttcagcggacgccaggccttgaaccacgcgatcgcgaagatgcccgcgttcagcagcgcgtagtagctgaacagcgcgacgtggttgccgtgcccggtcgacagcagcaccggtgcgagaaagccgcccgcggtgcccatgaacgcgagcggcagcgcgttctgccgcaccgcgaggaacgcgctcagcgcgcataccgcgaccatcagcggaaacgcggcgccgacgggcagcagcgcgtaaagcttggtcgcggcgaagatcgtcaggtacaggatgccgacgccgccaccctgcagcacgagcccgtacgccgcgcggcgcgcgcgcacgcgccagccgatcgcgagcagcgcggccgcggcgagcgcggtgcccgcgaggcggaattcgatcggcagcatgttgttgtcggccgcgtacttgagcaggaacgcgaccccgaagaacagcacgacgatcccgacgcgcacgaccgtgttgccgccgagcagccagtcgcgcgcggcgcggaatgcacgctcgacgatgtcgggctcgcgcggtttgggcggagtgggggaaccgatggtgcgggggccggagcggcaggcgtttcactcgcgtggagcgcagccggtaccggcgccggggccggagcaggagccggtgccgatatcgacgccggtgcgtccgcgcgcgcggcggccggctgggcaggcggacgcggcggcagcgtggcggaaggcgggacgggggcggatgagatcgcgggcggcgccgcggacaccgatgcggtgccggcgggcgtgtgcgccgtcgccgcggtcgaggtcgagccggccttcgcgccggccagctgaccgcgcagcgacgcgacttcacgtgtcagcgtctcgacggtggcttcgagccgcgcgacgcgatcggcgagcggaaccgtcggctgggcgggcggcgcctgcatcgcgaacgtgtcgggtgccgcgcctttgcccttgcgcttgcgctgttgcagcgtgtgatcgagacagaacccgatcgcggcgccgagcacggcgccgttgacggcggagaaatccccgatcaatgcggcaatcccgcccacgacgaagccgattgcggtaaaagcccagttcatctcgccttgctccctctctcgtatcgttatcggcctgcgatcggacgtatgccggtcgaggcggtgtcggcatggccggcaggcgaaccggcatgcacggctgaaggcggccgccgcatggcggcctgcgtcgcaatcagcctgttggcggggaatgtatcacagcggctgtcggggattttccgggtcggcgcggtatcgcggcgtgcaccttccggtgtcgtcgtacggcttttgcacggtcatgctttttatcggtgaatgccgcgcgtgcatttgtcaggctagttggccgcgggatcggacgtggaattgtcgtaaagcgacgcgcgtccgatgcgaattcgcgcataaaacgacgcgatatgcgccacgctgctgcgcacaagtccggcgcgtgatgcccgccgttgctggccgtgcgggtattgcgccgccgcaatcgcgtgccgccgcgcgccgtggcccgcccggcggggctggaggccgtgtcgtatttgcgcaagcgtttgtcgtaattcgtcggcaggtcggggtttttctggcaactatgtaggcacgctatgacacacgtgagtccccgctacacgaggagaaggtttcgatggatgcccccaaggtcgtggtcgaaggtctgtgcaaggtgtttggtagtaacccgcagcaggcgctcgacatgctcgccgccggcgcgacgaaggatgacgtgctgaagcgcaccggccaggtcgtcggcgtgcacaacgtctccttcgatgtgcaggaaggcgaaattttcgtgctgatgggcctgtccggctccggcaaatccacgctgatccgcctcgtgaaccggctggtcgatccgagcgccggcaaggtgatgatcgacgggctcgacgtcgcgtcggcgcgccgctcggcgctgaccgcgctgcgccgcaaggacatgagcatggtgttccagtcgttcgcgctgatgccgcatcgctccgtggtgtcgaacgccgcgttcggcctggaagtcgcgggcgtcggcaagaaggaacgcgaacgccgcgcgatggaagtgctcgagcaggtcggccttgcgccgttctcgcacaagctgccgtccgagctgtcgggcggcatgcagcagcgcgtgggcctcgcccgtgcgctggccgtgaacccgtcgctgatgatcatggacgaggcgttctccgcgctcgatccgctcaagcgccgcgaaatgcaggatgtgctgctgcaactgcagaaggaacagcgccgcacgatcatgttcgtgtcgcacgatctggaagaagcgctgcgcatcggcaaccgcatcgcgatcatggaaggcggccggctcgtgcaggtcggtacgccgcaggacatcatcgcgaacccggccgacgactacgtgcgcgcgttcttcgacggcatcgacaccagccgctacctcacggccggcgacctgatgcagacgggcgccgtgccgatcgtgtcgaagtgcgatgccgcgaacgtcgcggccacgctgaacggcagtgccgactatgcgttcgtgctcgacgcgcaacgcaagatccgcggcttcgtcacgcgcgatgcgatcggtcaggacaccccgtccgtgagcccgatcgaaagcatccggcgcgatgcgtcgctcgaacatgtcgtcgcgcgcgtggtcgcgagcccgaatgcgctgcctgtcgtcgacgacgacggctgctactgcggctcggtcgatcgtgcgctcatcctgaaggccatcacgcgttcgcgaggctcccatgtctgaaatgattccgctcggtacctgggtcgaccagtccgttcactacctgctcgaccatgacgccaagacgttcgacgcgatcggtcaagcgatcgaggggctcgcggccttcgtcgagcatggcctgcaggcgatcccgatgtggctgatgatggcgatcttcatcggcgtcgggctgtggcgggtgggctggcgcttcgcgctgttcaccaccgcgtcgctgctgctgatcttcgcgacgggcttctgggaccagaccgtcatcacgctcggcctcacgctgtcgtcgacgatcatcagcctcgtgctcggcatcccgctcggcatctgggccgcgaagagcaagtgggtcgccgcgatcgtgcgcccgatcctcgacctgatgcagacgatgccagcgttcgtctacctgattccggccgcgatgctgttcggtctcggccgcgtgccggggatcctgtcgacggtgatcttcgcgatgccgccggcggtgcgcctgacgagcctcggtatccggcacgtgaaccgcgagatcgtcgaagccggccaggccttcggctgcacgccgtggcagctgctgtacaaggtgcagttcccgaatgcgctgccgtcgatcatgcagggcgtgaaccagacgatcatgatggcgctgtcgatggtgatcatcgcgtcgatggtcggcgcgggcggcctcggcaacgacgtgctcgccagtatccagcgcctcgacatcggcctcggtttcgaaagcggcctgtcggtcgtgctgctcgcgatcattctcgaccgcatcaccgaaagcttcggccgcgcgccgggcaccgtgaaggcgccgctgttctcgggcctcaagcagctgtttcgcgtgaaggcctcacccgcacaggcctgacctccggcggccggaagccccggccgcttaccttgacgatagaaaacgacttccgcggcttcggccgcgggtggccctgcaacctcctcgccaggagaccgatgtgacgtccgccgtcgctgtcgcgcccgccgcctgcgtttcaccggtttcgtccctcgcccatttcggcttcctgacgctgccgaacttctcgatgatcgcgttctcgagcgccgtcgaagtgcttcggatggcgaattacgtcgggcgggccgatcactaccagtggtcgatctactcgctcgacggcagcccggtgcatgccagcaacggcatcgcggtacggccgacgcaggcgctcgactacacgaagctgcccgacgtgatgatcgtgtgcggcggcatccgcatccgcgacgtggtcgacgaagaggcgcgcgatacgctcgcggcgcttgccgaacgcggtctgccgctcggcggcatctgcacgggcgcgtatgcgctgatgtcgagcgggctgctcgacggctatcgctgcaccgtgcactgggagaacctgtcgtcgctgcatgccgagttcccgcaggtcgggttcgccgacgaactgttcgtcgtcgaccgcgaccggctgacctgcaccggcggcaccgcgccgctcgacctgatgctgaacctcgtcggcatgcggttcggccagcagctggccgcgcaggtatccgagcagttcatcctggagcgcatccgcagctcgaccgatacgcagccgattccggtcgatgcgcgcgtcggcttcgcgcgcggagctgatcgaggtcgtgcggctgatggaggcgaacatcgaggagccgctgtcgctcgaggaactcgcgcggctcgtgcggctgtcgcagcggcacctgcagcggatgttcaaggtgtatttgaacgtgtcgccgacccactattacctgacgctgcgcctgaagcgcgcgcgcgacctgctgcgcacgaccgacgcgtcgatcgcgcgcgtgacgacggtctgcgggtttcattcgccgtgccatttcagcaaggcctaccgcgcgcagttcggtcacgcgccgagctacgagcgcaggctgccggggcgctgactgtcgagaatcatccagtccgcgacgtcgccgggatcgcggcgcgcggcttcaataaacgatcccgcattcaagcaaacgacatcactttgaggagaagcaagatgaagcgcctattgatcgcagcggtgtgcgggatcgggataaccgcgccgatgtcggccgtttatgcggccgatccgcccgtgtgcaagaacgtgcgcttcgcggatgtcggctggtccgacatcgcggcgaccacgggcctcgccacgacgatgctgcaggctcggctacaacccgacgaagacgatcgcgtcggtgccgatcacgttcgcggggatcaagagcaagcagatcgacgtgttcctcggctactggtcgccgacgatggacccgatcatccagccgttcacgaaggccggcacgatcaaggtgctctccacgcccaacctgaccggcgcgaaatacacgctcgcggtgcccgactacgtctatcagggcggcctgaagtcgttcgcggacatccagaaatacgcggacaagctgaacggcaagatctacgggatcgagccgggcaacgacggcaacctgctgatcaagaagatgatcgacggcaaccagttcggcctcggcaagttcaagatggtcgagtcgagcgaggccgggatgctggtcgaggtgaatcgcgcgatccgcgacaagcagtggatcgtgttcctcggctgggagccgcatccgatgaacgtgcagatgaagatcgactacctgagcggcggcgacgacgtgttcggcccgaactacggcgaagcgaaggtgctgacggcgacgccgcccgactacgcgcagcgctgcccgaacgtcgcgaagttcgtgtcgaacctgcagttcacgacgacgatcgagaaccacgtgatggtgccgatcatgaacaaggtagagccgaacaaggcggccgccgagtggctgaaggcgaacccgcaggcgctcgacaagtggctcgcgggcgtgacgacgctcgacggcaagccggcctgccggcggtgaaggcgtatctcggcgtgcattgagcgacgcggccgggcgctcgcccggcccgcaagcggcttgacggattcgcgcccccgtcccggcaagattccgggagctgaggggcgtcagcatgcctgtccggcgtgagcaggcatcaggccacgacttgcatgagccacgcgttgatgcgtcgaatcacgtcgctccagtcgccttcgcgggtttgccgcacagcggtcgcatgcgcgatccaggggctcgcggtaccctcgacgccccagcgccagtcgccacagacgtgggtcggtacgcaagtccgcatccccatcatggccgccaggttggcgacacccgaatcgaccgcgaccacggcatccagttgggccatgcatgcagccgtgtcgccgaaatcccgaatcccgggccggtactgactaacattgccggccggcgtgcccgccagcgccgcggcagcgggtgatgcagattcacgaaatgcatgctttccgcaatggcggggtgtgccacgatcgcgtcgatcgcatcgagcggcaggctgcggcggctggcccagcacctgacgatggcgcctttttcgggccaatgccgttggacgcaatcccagaacagtccgatcagcttcttgcccggatgttgctcgcgcacttgcgcggcccattcggcagcgatccgctgcttgtgcggcggcgtcttgatgtagggcgcgaaccatcgttccggcaggcgtgtccgccgggctttcagcatcggcaaatgaagcagcgaggcatgcaggtccggcgcgaaaccgtcgacgcgtgcctgcagttcatcgggcaacggcgcatgaaactgcaccggattgggggcggcgacgatctcgcaccgcggcagtgacgcctgcatgagcgcgtggctctgcggatggcaggtgagcatgacgtgcgcgccttcgtccagccagtcggccacgcaggccgagaggagaaagttgtcgccgaagccgtgttcatgcgtgatcaggacacgcctgccgcgcacatccgattcgccgtcccatgtcggcaggtcgaccgggcggtaattggcggacaggcgcggaacgtcgtcacgcattcgccaataggcgaagccgcgcggatcgcccgccttgagcatcgcttctcccatcgcgaatccgatcgatgccctcatctcggcagggccggatgccgccatccggaaggcttcgtcgagcaacgcgatggcctgcgcgagatcgccggccatcatcaggctcatgcccagtcgcaagcggtggagttcgggccggctgtgccgcgacggatcgcgtttccaggcttcggcggcttcgacatagcggcccagcaggtagagcgcatcggcacgccgtgtcatggagacggcgtcgtgcgggtcgagcgccagcgccaggtcggcccagggagcatttcctcctctcgctggagggcagtcaacagttcgcagatccgatgcaggatcgcgggatcatgcgaatcgccggcgtattgcgtctgcgcggcatgcagttgctgttcgaggtcgaccatgaatgcggttccggcgggcgcgctcaccgtgcgaggcgggcgcaacgggatccggcgcgagcagggggccggcggtgggcatcgcgatgccggcacctcgccggggcgtcgatgccggccgtgtcgtcgcaggggctatacacggaatgcgccgtcgaagatgacggtgtcgtcgaacaggatctttccggacgaaaacaccagatccagatgatggctgccgcgttcaccgccgccgaggccaaggtgcaacccgggatggcgttcttcgaaacttgcattgcgtccatgcagcctgacgttcaggttcgtcccgatcccgaactcctcgacgatcctgtttcccgcgcatttgtcgagatacaacctgaaatcgtcctcgagctgtcgattggccgattcgacgctgaccacctggctccgctcgatcccgatcttcaatatcgggtcgatgacaccgtacttgatggcaaagggcaccgtgctcaggaaggtgccgccgaacaagacgcttccggtcaggtcgagtacgcgggtcgccacttcgccgggcatcaggtcgtagtggttgcggccatcgaggcttttccatgtctgatccagcgttccgtgcagcgaaccgccgaagccgtcgtgaaattgcacgcgtcgagcgcgttgtgccgccgcaatgatgcgttcgttgcgggccgcaatgtcgtcgatgctctcggaaaaggcctccttgaagaattcgccgtattcccgcagcaataccgacttcttccagtgctcggccattttcggcttgaggggcgggatgaacgacggcccatgcgggttgatgtcggaacgtatggacgagtcgtacatgaagatgaacatgtcacaccggtcgatttcctttatgacctgttcgtgattttccgtgtcaagctcgacgtaggtgaacgaatattcgagtttttcgggcagtgccggataatcgattgcgcggtatttctctggctttgatccgagccgaccaggatgttggcgccggctgaatgtttctgcaccatggctggatgaccgcggacacacgaaaagaaattttcgacactttttccatgattatctccggggtatccagtttctggatcaaaaatggcgggtcattgcgatccgccatcgttcgggctgcctgcttaggcccacagagccgttgcgaatggaatgactgcgctgtccttcatcatctcgacccagtcttcatgctgatcttcctgcatccattcgatcagcgggagatcctgcttttcctgattttcgttcatgatgatttccttgtttaggaattgaactgcgaacatcgcaaatcgccccgaaaattcgagggcggatttagcgattgagtgagcgcatggggttgcgccgattatatggggtgggtgtgaatgattgctttctgttaatcgtcagacaacattagcattcgaatttgcggagggacaatgtaacgtaaaccctagggttgttttgattttgtgaatgctggtggcggtggtgtttgaatgtcgaaaaatgaaacggggtgtgttttgaaacgggaataaacgcaccgattgatgtcgatttcgactacttgattaccgggtgctcgtttcattccccttcgtcgccgcgggcacgtcgaacacgcgatcgaacgcccactggaaggcgaacgcgtaacagaagaagaacgcaaacagcccgatgtcgacgacgaacgcgtcgaaccacgagatgtcgagccaccacgacacgacgggcaccaggatgaagatgagcccgccttcgaatccggtggcgtgcaggatccgccgcccgagcgtgcgtgccggctgccggcgcgacgcttcccagcgctcgaacagcgcgttgaagatcatgttccacagcatcgcgatcgccgacatcgtcgccgacagcgcgcccgaatagacgaggccctgcttgaagagcgccgcgatcacgggcgagatgcaggaaatcgcgatcgcttcgtagagcaccgcctgcgtgatcctgcgcgataggccttgcacgttgtttctccggttcgacgtcattcgccgcggcaccctgccgtgacgtcccgcaaggctattcgcgttgcacgcccgcttcaattcacctaatctcaccccgattcaatcgaattcaacccggcctgatccggcccgcgaggccccgtgttctcgaaacttccctgaccgcattgcgtgtattcgaagcgtcggcgcggcttggcgcgttcaaggctgccgcggacgagctgtccgtgacgccggccgccgtgtcgcaccagatcaagtcgctcgaaagccggctcggcgtgctgctgttcgagcgcggcgcgagcggcgtgcggctcacggaggagggcgagcaactgtttcgcgcgagtcacgatgcattgctggcgctgagccgcgggctcgatgcggtgcggccggaagcgaccggcgagcgcacgctcgtgctgaccaccacgcccgcattcgccgcgatgtggctgattccgcgtctcgggcggtttcgtcgcatcgatccgcaactgcacatcaaggtcgaaaccggcaacacgctcgccgatctcgaacgcgatgcgcggatcgatctcgcgattcgcgcaacgtcgcgcacgtttccggcgctgcacgagattgcgctgatcgacgagtatttcggcgcctatgcggccgccgggttcgacgcgcaccgcacggacgagccgctcgacctgatcgagaccgtgtgggatacgccgttgccggtgtcggtcgactgggcgtcgtggtgtcgtgcggcaggccgcgacgcgtggctcgaacgcgcggtgtttcgccattacgacgacgagcattacgcgttgcaggccgtgctgcacgggcagggcatcgcgctgctcagctcggtgctggctgccgagcatgtcgcgcacggggcactgacgccgatcgagccgtcggtgcggctcgacggcgcgcgtttcgtcgcgctgtgccggcccgggcgtgagcgtgagccgcaggtcaggtcgtttctcgactggctcgaagcggagatcgcgcagacgcgggcggcagtggcgcggatgggggcgggcgtcgagcgctaaagcggggcggcgcgggccgtgtgcgaacggtgcgcccgtacaccgtcacccgaacctgacgcaatacaccggcggcaaatgcgcggacaccaaccgccagttttccccgccgtcatcggacgtccacaacccgccggtcgtcgacgccatcgcgaggcgcgtgcccgaatcgtccaccgcgagcccgtgccgatacacgaggtcgtacgcgggtgcgggcggcagcccgttcgtgaatgactcgaaactgcgcccgccgtcgcgcgtgcgcgtgacgacgaaccggccgtccaccggaatccggcacgcgtccttcacggccggcacgaaccacgcggtgtccggctcgtgcggatgcacggccaccgcgaaaccgaagctcgacggctgtgcctcgatcctccgccagtgttcggcgccgtcggtcgagcggaagatcgcgcagtgatgctgcgtccacagcacgtccgggttggccgcgcactgcacgacgcggtgcgggtcctgcgcgttgggttcgccgcgccgctcgggcggcatgtagtcggcttccatgccgtcggccgtcacacgccaggtcgcgccgccgtcggcggtctgccagacgccgccgcacgagatgccgatcgtcacgtgccggctgtcgcgcggatcgaccatcaccgaatggatgcccggcgcatcgtatccgccgccgccccattcggcgcgctccgggcgatcccacaatgcccggttgagcacccaggaaccgccgccgtcgtcggagcggaacagcccgccgggaatcgtgcccgcccacagcacgcccggctcgtcggtgccgccggcttcgagcgaccagatctgctggagcgtccacggcggctgcggcgggccgggcggcgcgtcgcccgtgtcgcttgcggcgcccgtgcccgacggggcgctcgcgggcggatcgtcggcaggctgcggcggatatacaggcaccgcgcattcttcccagtcgggggcgccggcccgcctgcgatgcagtttcacgccgaaatgccccaggttgagcgctgcatacagcgtgccgtcgcgcgggtcggcgagcgccatgctgaccggctcgccggcgaaatgcggctcgccgagcgtccagccgccgttgccgtcgggttgcaggacgaacaggcccttgcgggtggcgacgagcagtcgatcgttcatgtgcgatgtctcctgatggcccgacctggcgttccggctcgcggtcggcgcttgtgcatgcgtccctttatccgcccgtcagcgcctgcacgacatagacccggctcgcgtcgccgagcacgtcggacaggcgctgacggtcgcgtatcggctggccgtcgatgaataccgacaggtgtttgcgcagcgcgccctggtcgtcgaggatgtagccgcgcagtcgcggctgctcgccgaaaacgatgtcgaatgcttcgccgagcgtgcgggcgtcgatttcgcgctcgggcgtttcgatatgccgctggatcgaggcggcgaagaagaggtgcgccatggcggtggctggcaggagccgcgcggaggggacggtctttagtttaggcgatccgtcgggggcgcaaagacggcgtctcgtagtcgccgtgcgtcggcgtgtcgatccgtcgcggtcgacacgatcacgcggatcggcaacaattctgcccgggccgccgggccgccgggccgccgggccgccgggccgccgggccgccgtgccgctcgacggtcgcacgctctccacttgccgatgaaggaaatccccgccatgccgcgatccgcgctgtcgatcgtcaacccggccgtcgacgatatcgtcgcgggccgcaagcgcgtggaaatccgctcgtgggcgccgccggccatgcagttgcgcgatctcgtgctggtgcagaacacgatcttcctgcgacaggacgggcaggaggatcccgacggtatcgcgctcgcgatggtcgatgtcgtggggtgcacgactggacgcccgacgaagcccgctcgcaaggcaagcaatggtgtgccggatacgtgtgctgggaactggagaacgttcggcagatcgcgccgcctgttccgtgcgttgcgaagcgtggcatctatgcgttgccggatgatttcggaaaggtatcctgatgatttcgcctgcatcaggggcgaaccgaacgccctttcgaaacaagagagggcagtcgagacgaaggatcacccggagcgtgcccgccgcccgcgctaaaccggaatcgatcgcccgcgtatcctgatcccgatccgcacgatgccgatcaccgcattcgacagccacgtgagcaggcgcggcattccgcgtcggcggatatcgagcagcagcacgatccgcacggcgtcgctgtcgttccacacctcgtgcatgaacgtatcgtcccacagcaggaaacggccttcgtcgagccggtattcgtggccgtccaccttcagcacggcggccggcgcaccatccgcgcgcttcggcatcgacagcacgagatagccgcgcaggatgccgcgaaacggcccgcgatgcggtggaatgtgcttgccgggtgcgaggaacgacagcgatgcggacagcacgtccggcgacgtcgcgacgatcgacgcgacggtcgggcagcgcgacaggttgcgcgggaacggctggccgtacgcctgcatgatgaacatccgccagtcgcgtgcatcgttggccgagatgtcgtactgctcgcgcatgatctcgtggaaacgcgggatgcgcgccatgtcgcgcgccacggcgaatgcctccgcctggatggcgggccacgcacggacgaaacgctcggcatcgggaaacgcggccgtatcgagcaccgcgccgccgtcgatatggcggtcgtacagcgtgcgcagcaggccggctgcatagtcgtaagcgacggacatggtcgatcgaggcgcgatccggaaaggatgacgtcagtctgcccgaagcgggtcgggcgctgcgttacgtcaggttacgccggctgacgaaagaatgacaggttcatgaatgttcgttccacgcgccccggagccggagaagccgcgtgaatcgagctgcgacatgcgggaataaatgcacacgctccgtcgtcatacgggtgtagcacgtcgtctcgttgacttcttgaggagtggaacatgaacaagcattggctggtggccgccgccgtggcggcgatttctttcgcgggtgtcgcggcgcccgcatcggcgcaggcactgacgcgcgcgcaggtcaggcagcaactgatcgatgccgagaaccaggggctgcgcttcgtgaccgatacgtcgtatccggacgtgagcccgctgttccggcagcaggtcgaacggatgccgcagcgccaggccggcacggcagtcggcagcgagccggccgcctcgtccgatgcaggcaagccggcgacgatggcgccgcgccagcgttccgccgcatgcgtcggcccggcgagtttctgcacgatctatttcggcagctgacgcagccgcccgcgttcgcagggctggcattcacccaggttgatcgatacggaacattgaaggagctcatgatgaaagcatatatcgcagtactgacgatgatcgcggcgatcgtcggtcagtcggccttcgcgcaatcggccgcgccgctgacgcgcgcgcaggttcgcgacgaattgatgcgcctggaagcagccgggtacgacccggcgaaaggggacgacggcgagtatccggcggacatccaggcggcgcaagcgaagcttgccgaacaggaccgggcccggatggcggctgccggcgcgcatgcgccggcggccggtatgccggcgcaggacagcaactaggtgtcgatatggtcttgtgcgacttcaggccgtcgtgttcgcggcacggccgtccggcagccgttcgtgccgcccgacgcggtggatggacaccggccgccgtgcccgtcatcgcgcgccgcttcgctcggcgccgcgatcatctggccggcggcgcgcgatgatccggccggccggtcgcgcgatgagccggggcgacgacgggtgcggcgctggcggcaggccggttcatgcgcgcgatggcatgccgtgctgccgatcgcgcgatcaccagggcatcatgcgctgcaggatctgatcgcgcagcacgaagcggtgcgccagcgccgctgcgacgtgcaggcaaatgccggcgaacagcgcccaggcgaggatgccgtgcacatcgcccatcgcatggccgaatccggaaccggccgctgacagcgcgggcagcggcacgatcccgagcagcgtcacgccccacgcccgcgacgatgcgttgatccaaccgagcagcggcacggcgatcagcagcgcgtagagcgcgaaatgcgtgacgcccgacagcgcacgcattgcgggagacaggtcgttcgccggcgggcgatgcgtcgcgcgccacagcacgcggcaggccatcgcggcgagcagtgcggtgcccacgatcaggtgcgcggcgatcaggccgacgggttgcgtatcgcgatgcacgtcgggcatcgtccagccgatcgcatattgggcgacgatcagcgcgacgatcagccagtgaagaaaacgcgcaacggtgtcataacgggcgggtgtggacatgaaggctcctgcgtacgacggggacggtattggacgggtggattctacgaccgcatgcttaacgaaacgttaagcacgcggcatcacatgcggtgatcggtcgtcgggtgagcctgccggccgcgcttcgcccgcgtccgccgacggcagtgcaaccgcgacgccgagaccctggccgccgatgccgggcccgaactgcacggtgccgcccaggtattgcgcgatgcgcgtgacgatcgacaacccgagcccgctgccgggcgactgcgcgccgctgccgcgatagaagcggtcgccgagccgctcgtactcgccggggcgacgccgggcccgtcgtcgcgaacgacgatgcattgcagtgcgccgtcgtcgcgcacgccgagctcgatgcggccgcccgggcggccgtacttcacggcgttgtcgacgaggttgtcgagcaggatgccgatcaggattggatcggcgtcgatcgcgcgtccggagacggggccggccacgaggtcgatggccttgtccgacgccttcgcgagatggcggtcgagcgcagcttcgacgagttcgcgaacggcgaccgcgcgtgtcggaatgcgttcgtattcgtcgagccgcgcgagcagcagcaactgctcggcgagacgcgcactgcggtcgacgccttgaacgacccgctgcatcgccagccgctggagtgccggatcgtcggtcgcaatggccacctgggcctggaccttgatcgcggcgagcggtgtcttgagctcgtgcgcggcgtcggacgtgaacgcgcgctcgcgcacgatcgattgccgcagccgggccagcaggcggtcgatcgcgtcgaccagcgggcgcacttcgtccggcacggcggcgatgccgagcggttcgagcgatcgcgcgtcgcgcgcgccgatcagcgtcgacagcgtcttcaacggcgcgagaccgcgtccgatcaggtaccagaggagcagcgccagcaccgggagcgcgacgatcaacggcaggacgatgccgcgcgcggtgccggtcgccaggtcgctgcgcgtgttcgcgatttccatcacgcggatccagcgccccgacgcgtcgtcgcgcagcgtgtgcgtacgccatgacgcgtcgcggatgacgatcgtttcgggaataccgcgcgagtcgtgcgcgtcgggcaggccggcggcgccggccgggaggctcgacgcgacgacctggccccgtgcgtcgcgcacctcgaacagcacgtcgcgcggaaggcgatcgccgtcggtttcggggccgggtttcgagccgcggcgatccagttcgacacgcgcgtccggcggaacacgggcgaggcggccgaggtcggcaggcgagagattgaccagcagcgatgcatattcgacgaggcgggcgtcttcccattcgccgatctcgcgcgtcgcgtaccggaagctgccgaacacggcggcgagccacacgaccgtcacgcagccgagcgccatcgacgaaacgcggcgccgtatcgagcgggacgtcatgcgagatcgacgacgtagccgacgcctcgaacggtgcggatcagttccgcgccgagcttcttgcgcaggttcgacacatgcacctcgatcgcattgctttcgataccttcctgccagccgtacagggtgtcctcgaggcgcgagcgcgactgcggcgcgcccgggtggctgaccaactgaaccaggatggcccactcgcgcgacgtgagcgcgatgcgcgacgcatcgcgtgtcaccgtgtgggcggtcaggtcgatcgtgatgtcgcgccacacgatctcgtcgccggcgcggccctgcgagcggcgcacgagcgcacggcagcgggcgagcacttcggtcagttcgaacggtttcgcgagatagtcgtcggcgccgtcgtcgaggccgcggacgcggtcggccacggtgccgcgcgcggtcaggaccagcacggggacggtgtcgcccgcatcgcgcaacgcgcgcagcagctcggtgcccgatttcccgggcaggccgagatcgagcacgacgagcgcgaagcgcgtcgtcgcgagggcggctgccgctgcgtgaccgtcgcgcaaccagtcgacgtgatagcccgcctgggtcaggctgatctcgagaccgctgccgatcaggtcgtcgtcttcaacaaggaggagtcgcatggtcgattcgggggcaggatgcctgcgattgtacgagcgcgacccgcctgccgcgcaacggaatgtaattgtgctggatcaaacttctcccgattctgaagaacgcttaaggttcggcggcggcaatcccgctaccatcggccacaccgtttccaggggattttccgctgcccctgatcccgaaccgggtcacgcctgtccggcttgcccgtcaatccgcgaccttgccgatcgatgtccgatcgacgcgagtcgcccgtacgggagattcattcctcatggccccctcaacgatcgagcgatggcgcgcctacctgctgatcgccgcgctggccggcatgttcgttcagtgcttcgtgctggtttcatggctggcgctgcgcgtacccgaggcatttttcacgacgatgacgtttcgcatgtggaccgtcgtcgcgatcgtcaccgcgatcctttcggtccgcaagcttgcccgcgcggcgttcagagcggcgctggattgcggattcgtacacgtgaccggaatcgatcgtcacacggtagccgtgtcatccgattgcgcgtaccgtcggctggtcatccttcatatccggctcaacggaaatcggttccgctacgcacacgggtgagcccgccttcgcgcgtgcccgccccgacgcaccacggtcccgccgggccaccactggggaatcgcatggtgttgctgcatgtgctgcacgcgctggccggcgcgatgtcgatcgtctgcgggctgggcgtattgctgggtattgcgtatacggtcgcggccagcgtgctggtcgggcggttctttcgaggccggcggcgcagccgcgcgagtatccgggcgtcaccgtcgcgaagccgctgcacggcgacgagtggcagctcgtacagcatctcgaaagcttcttcgtgcagaattatccgggccccgtccagcacctgttcggcgtgcacgatgcaggcgacgcggcactcgcggccgtcgagacgctgcgtgcacgctaccctgacgcgaacatcaaggtcgtcgccgatgcgcggctgtacgggccgaaccgcaagatcggcaatctcgtgaacatgctcgaacacgcggagtatgcggtgctgtgcctcgccgacagcgacgtgctggtcgagcgcgattatctgcgcgcggttgtcggcgcgctgcaacagccggatgtcggtatcgtgacgagcgtgtaccgcggtgtcgcatcgccgggtttctggcccaggatcgccgtcgcgatgacgaactaccatttcctgccgggcgtgatcaccgggctctgcatcgggcgtgcgcggccctgctttggccagacgattgcgatcacgcgcgcgacgctcgaacgtatcggcggcctcgcgcgattcgcgcatcacctggccgaggatcacgcgctgggcgaagcggtgcggcaggcgggcgcgcaggtcgtcattccgccgttcgtcgtcgggcatgcgtgcgtcgaggagacgttctcaaggctgtacgcccacgagttgcgctggagctgcacgattcgcgcggcggaccggctcggtcatgcgggctcggtgctgatgcacccggtgccgctcgcgctgctggcgctgctgttctcgggcggcacggccaccgcgtgcgcgctggcggtcgcggcgctcgccgcgcgggtgctgctgatgctgaaaaccagccgtgcaaccggcgcggggctgcgcggcgcaatctggctgccgttcgtcgatctcctgcagttcttcgtgttcgtgtcgagcttcttctcgtcgcatgtcgtgtggcgcggcacgcgctttcgcgtaaaccgggaagggcggttgtcggcggcgagcgaatcatgacgacgcagacgaaccccggcggcgacgccgcccggaacgtcacgcgcagcgacgcgcggcttcggcgcgcggggcaggcagcggcgctgggcgggctggcgctcgccgtgtggctgatctggcgcgagcatccgctggacatcctgcatcgcctgcagattgccggcgccgggctgctgctcgcggcgctggttcaccttctgccgatgctcgcgaatgcgtgggactggcggatgctgatccgcggcccgcgccggccgtcgttcgcgacgatgctgaaactcgtgtggattcgcgagtcgatcaacgggctgctgccggtcgcgcggatcggcggcgagatcgtgtcgttcggcctgctgcggcaggcgggcgtgcggccggcgacgatcgtggccagcctcgtcgccgacatgcagctgacgctgatcagccagctggtgttcgcgctggtcgcgatcggctacgtgctcgggcacgtctcgtccgatgccgcccgggtggccgggaatctcgcgatcggcatggccgcgctggtgccggtgctgctgctgttcgcgctggtgcagcatgcgcggccgttcgagcgcgcgatgcgcgtgctgaaccgcgtcacgagcgggaaggtggtggcgctcgtcggcgaatcggcgcgtaccgatcagtcgatccggatgatctggagaaagaccggcatcgtcgtgcgctacctcgcgatctggcagccctgcagttcgtgggctacgcgctggaaatctggctcgcgctggtctttctcggcgcggagccgaccttcgcgcaggcgctcgcgatcgaggcgctgatccagctcgtgagcagtatcgcgttcctgatgccgggcggcctcggcgtgcaggagggcggcttcgtgctgatcggcgggctcctcgggttcgatccgccgacgtgtctcgcgctggccggcgcccgccgcgtgcgcgacctgctgttctatctgccgggcctgctcgcgtggcagtgggcggccggttcggcgaaccggccgggcggaacgaaacgcgcgtcgttgcccatcgggaatccgcccggccgcattgacgcggccacgcaggccgtgcccgcgcggccggcggcacgggaatcagcgccgttcgtcggcgagatggctgcggatcacgtccgcgaacgacgtgtcgcccgtcaatccgagggcttccgcgcgcgacgtatcccagcggcccggccagctgccgacgatcttctcgacgcgctcgtcgggcacatggcggatcagcttcacgacttcgtcgcccgcgacttcgcgcagcgccgcgatcatttcgtcgaccgataccgacaggccgggcaaattgatcacgcgtttgttgcccagcttcgcgctgtcgatttcgcagcccgcgacgagcgcttcgatcgcgccgcgcggcgacagcagccacagccgcgtcgaacccggcaccgggcacacgctttcctcgccgttcagcggctcgcggatgatgccgctcgcgaacgacgacgcggccgcattcgggcggcccggccgcacgctgatcgtcggcagccgcagcacgcggccgtcgacgaagccgcgccgcgcgtagtcgcacagcagcagctcggcgatcgccttctcggcgccgtacgacgactgcgggttcagcgcggtgtcgtcctgcacgacgtcggggagcgtgccgccatacaccgcgaccgagctcgtgaacacgacgcgcggccggtggccacgcgcgcggcacacttcgagcagcgcgcgcgacgcgtcgaggttgatccgcatgccgagatcgaaatcggcctcggcctgcccgctgacgattgccgcgaggtggaagatcgcgccggtttgcgtgtcgatcgcgcgttcgagcaccgcgcgatcggcgatgtcgccgacgatcgacgtcacgcgcgcatcgccgaaatcgctgccttcgacgacgtcgagcagcaccagctcgtcgatcttctcgctgcggccgtcggggccgctcagttcgccgcgctcgagcagcttgcgcgccaggcgctggccgagaaagccggcgccgccggtgatcagtactttcatgttcgttaccttccgaggaatgcgtgaattagcgggagcaggccctgagccagccgagcccttccgacgtgccggccttcgggcggtactcgcaaccgatccagccgtcgtagccgagcgtgtcgatcagctcgaacagatacggatagttgagttcgccgagatccggctcgtggcggtcgggcacgcccgcgatctggatatggccgatgcccgcgaaatcgcgccggagcttggtcgcgagatcgccttcgacgatctggcagtggtagcagtcgaactgcaccttcaggttcggcgcgccgacttccgcgcggatcgcctgcgcgtcgtcctgacggctcaggaaatagccgggcatgtcgcgctggttgatcggctcgatcaggatcgtgatgccgtgcgcggcagcggcctgcgcggcatggcgcaggttcgacaggtaggtgtcgcgatggcgcgcgcggtcggcgcccggcggcaccatcccggccatcacgtgcagcttccggttgccgagcacgcgtgcatagtcgagcgcctggtcgatgccgcgccggaactcgtcctcgcggcccggcagcgatgcggtgccgcgttcgcccgcggcccagtcgccgggcggcgcgttgaacagcgcctgttcgaggttgtgcgcgtcgaggcgcgcgcggatatcttcggcggcgaagtcgtacgggaacaggtactcgacggccttgaagccgtcgtatgcggcagcggcgaagcgttcgaggaacgcgtgctcggtgtacatcatcgagaggttggcggcgaagcgtggcatggcagcgggtcctgtgaatgaatggggcggggcatacgtcgccccgcgtcgaatggcaactcggcggttcagcggttcacgagtttcgcgggcgtgagccacacggcgatcgcgccgatcacgagcattgcggccagcacgtacatgccggacgccgtgctgtgcgtgacgtccttcaggtagccgatcacgtacgggctcgcgaacccggcgaggttgccgaccgagttgatgatcgcgatcccggcggcggccgcggagcccgcgaggaacgcggtcggcagcgaccagaacagcggtgcgcaggtcagcacgccgcccgccgcgagcgacaggaacacgatcgacaccgccgtattgtgcgagtacgacgcggcgaccgcaaacccgaccgcgcccatcagcgcgggcacgatcaggtgccagcggcgttcgcggcgcttgtccgcgctgtggccgaacaggttcatcacgacgatcgcgacgaggaacgggatcgcggacagcaggccgatctgcagcgtatcggtgatgccggtcgacttcacgagcgtcggcatccagaacgtgaggccgtactggcccgtgacgaacgcgaagtagatcagcgacatccaccacatgcgcgggtcggcgaacacggccttcagcgagtggccgtgctgctgctgttcctgcggctgcgcggcgatctcgtcctccagcagttgtttctcgcgttcgtcgagccacttcgcgccgcggatgctgttgtcgagatacaggatcgtcgcgatgccgacgagcacggccggcacggcttcgatcatgaacatccattgccagccgtggaaacccgagccgccgtggaagcgctccatgatccagcccgacagcgggttgccgaagatgcccgacacgggaattgcggacatgaacaccgcgatgatcttcgcgcggcgatgcgacgggaaccagtacgtgagatacaggatcacgccgggatagaagccggcttccgcgaggccgagcaggaagcgcagcacgtagaactgcgtcggcgtctgcacgaatgcgaacagcccggacagcaggccccacgtgatcatgatccgcgcgatccagatgcgtgcgccgatgcggtgcatcagcatgttgcttggcagttcgaacagaaaatagccaaggaagaagatgccggcgccgagcccgaacacggtttcgctgaacgcgagatcctgcgacatctgcagcttcgcgaagccgacgttcacgcggtcgagatacgcgaccacgtagcagagcatcaggaacggcacgatgcgccagaacactttcttgtaggtgcggtcgagttccgcggcatgggcgggcgcggcgggcgagcggccagcggccgcgtcgagagcagtcatcgtcgtctccaggatgttgtgtgccggcggcgtgtacgccgccggatcatgtgtgtgctgacggaagggcccgcgcacacggcgggcatgggaatcgttgcggggtacgtcgctaccagcgcgcgccgaagctggcgcgcaattcgtcgagcgcggcctcgtcgagcggtttgggtttcgggttcgtcatcagccacagccgcgccgtttcctcgagctcttcgagcgcatacgacgcgtgcgacaccgatggcccccacatcaccgggccgaggcggtcgagcagcacgccgcgcacctggtcggcgagcgccgcgacttccgcggcgacgcccggatcgccggggcggcggtagcggatcagcggaatgtggccgaccttcatcacgtagtacggcgtgatcggcggcagcacgtcggtgtcgcgccatacgcccgcgagcgtcagcgcgacgaggtgcgtcgaatgggtgtggacgatgccgttcgcttcggcattgcgtgcgtagatgccgcgatgcagtgcgagcgtcttcgacggcttgccgcccgatacgggccggccgtcgaggccgaccttcgcgatgtcgttcgggtcgagccggccgaggcacgcgtcggtcggcgtgatcagccagccgtcgggtagccgcgcgctgatgttgccggcgctgccgaccgcgtggccgcgcgcgtacaggctggcgccgacgacgcagatctcctcgcgcagtttcgcttcgtcgctcatcgtgcggctccgtccagcgcgcgcagcgccttgtcgaaaaagtccgtggtgccgaagttgccggacttcagcgcgaggccgagcggtgccgcgtcgatggtggccgtcgccggcacgcccggatcgatctgcgcgccgatctgcagcgacttcacgtcgagcgcctgcacgaccgcgccggacgtctcgccgccggcgacgacgaacttgcgcacgccgagatcgcgcagcccgcgcgcgatcgccgcgagcgtggcttcgacgagatggccggccgcgtcgacgccgagcgcttgttgtacggccttcacttcgtcaggcgtcgcggtcgcgtagatcagcacgggctgcggcaggtgcgtgcgcgcgaacgcgagtgcctggtcgacgacgggttcgccgcgcgatcccgcgagcggatcgatgcggaagctcggccgcgtggcgcgccatgcggcgacctgcgcgttggtggccttcgatgcgctgccggcgagcaccgccgacaggccgtcgatacgcggcagcgacgccgcgttgtcgcgctcgggcagttgctccgcgcggcggaaattcgcgggcaggccgagcgcgatgcccgagccgccggtgacgagcggcaggcccgcgcaggcctcgccgagcacgtagaggtcgcggtccgacagcgcgtcggcgatcgcgaatcgtgcgccttccgcacgcaactggtcgatccgcgtgcgcacggcggccgcgcccagcgcgatcgtgtcgtagcggatcaggccgacgggcgacttcgtttgccgctgcagcacgcgcacgaggttcgcgtccttcatcggcgtgagcggatggttttccatgcccgattcgttcagcagcacgtcgccgacgaacaggtggccgcgatagatcgtgcggccgttctcgggaacgccgggcacgcgatcgtgaagccgccgccggccgcatcgagcagcgcatcggcgacgggcccgatgttgcccgcgtcggtcgaatcgaacgtcgagcagtacttgaagaagaattgccggcagccttgctcgcgcagccatgcgtaggcggcgagcgattgcgcgacggcgtcggccgcggggatcgtgcgcgacttcagcgcgacgacgatcgcatccgcatcgatcagcgtgtcgactgcggcaccgtcggcaggcacgccgatcgtctgcacggtgcgcatgccgctcttcacgagcatgttcgcgagatcggtcgcgccggtgaaatcgtcggcgatgcagccgagcaggggacgggaaacgggagcggtcatggcgggtacgtcgttcgaatcagcgggcaggcggcagcgtgatgccggggaaggtcttgatcacggcggaatcgtcctcgccgccgtggccggcgctcgacgcgctcatgaacatctggtgcgcggtggccgacagcggcagcgggaacttgctgcggcgcgcggtatcgagcacgaggccgagatccttcacgaagatgtcgacggccgacagcggcgtgtagtcgccgttcaggatgtgcggcacgcggttctcgaacatccacgaattgccggcgctgtgcgtgatcacgtcgtacagcgcgtcggcatcgacgccttcgcgcaggcccagcgccatcgcctcggccgccgcggcgatatgcacgccggccagcaactggttgatgatctttaccttcgagccaatgccgtgcgcatcgccgagtcgatagaccttgccggcgatcgcggcgagcacgtcctcgcagcccgcgtacgcggcggccgggcccgacgtcatcatcgtcatctcgccggaggccgcgcgcgcggcgccgccggatacgggcgcatcgagcatctgcaggccggcggcctcgatgcgtgcgccgagtgccaccgcgaattccggtgcgacggttgcgctggcgatcacgacgccgcccggcttcatcgccgcgaccgcgccgtgctcgccgaacagcaccgtttcggtctgcgcggcattcacgacgagcgtgacgacgacgtcgcactgcgcgccgagttcggccggcgtcgcgcaggcgacgccgccttcggccgcgaatgcctgcagcacggtgtcgcgcacgtcgcatgcgtgcacgcgcaggccggcgcgcagcagcgagcgggcgacgccgaggcccatcgcgccgaggccgatgactccaacatttcgtgacatggtcaaccttgatcgattcgggagaggttcgtgacagcggcggcgcctgtaacggccgccgccgccggcttcagcagatgccggcttccgcgagacggcgggcggcgttgtacatgtgcgtgcgcgccgcgttgcgcgcggccatcgggtcgcgcgcgcggatcgcgtcggcgatcgccgcgtgttcctcgcgcacctggcgcgagaagtcctcgcgcgtcgcttcgttgcgccgcgtgaccttcacgccggcttcgaggtactggttcaggaactgcagcgtcttcaggaaatacgggttgccggtgacggccgcgatcgtgcggtggaacgcgacatcttccgcgacgccgtcgcgcccttcggccacggcatcgtcgatcttgcgcagcgcctcgtcgatgtcggccatgtcttcgtcggtgtggtgcagggccgcttcggccgcgacctcggcctcgatcgcgcggcgcaccgcgagcaggtgcggcagcgaggtggcctcgaccgcttccgcatagtcgatccgcagcggccggatcgcgccgtgctggttcacgtacacgccgctgccctggcgtggctcgaccacgccttcgttcttcagccgcgagatcgcctcgcggatcacggtgcggctcacgccgaattcctgcgcgagcacggcctccgtcggcagcttgccggtggccgagaagctgccgacttcgatctgcttgagcagttgttgcgcgacatggtcgctcatcgcacgggcgggaattttctcgaacatggtgctctggcttgtaaggttatgtggtcatcgtacaaatttgaacgcgatgaagcatccgggataaccctcgatcaacggagggcaacgtcggccaaatcaactgaaaccggttccatttgaaggaaatcgacgcgatcgactatcgcttcgcggtgggtcagccgggcgggaaagagcagtgcgggtgtgttggcggtcagtcggcgatgtcctcgacggagtcgtccgtcgcatctgccgtcgcgccggcttccgccacttcgccgccgcgctcccgataagtcgccggcggcacgccgaactgcttgcggaactcgcgtccgaggtgcgacgcatcggcgaacccgcagctcgacgcgatatcggccaccgtgcggtcggaactggtcagcagccacgcggccgtgcgcagccgcacctgtttcgcgaacgcctgcgggctcttgcccgtttccgccttgaacagccgttcgagctgccgcgtcgacaggtcgagcttgttcgcgagctcgtcgagcgacagcgcccgcccgacatgctgttccatcaggagaatcgcgcgcttgaccttcgggtgcgtcgccggctcgaggcccggcggatgcggctgcgggcattccctttctgcatctcgccgaccagcaggatgcgcagcgccttctgcacggtcgcgtgatcgaaatggcgcagcaggatcgcggcggcgacgtcgatcgacgcacggccgcccgagcaggtgatgcggcgccggtcgatcacgaacagccggtcggcgatcagcaggtcgggatcggcggccggaaagcgctcgatgaaatcccagtaatggaaccagctcacgcaggtgcggtagccgtcgagcacgcctgcgcgcatcagcgtgaacacgccggtgcagatcccgacgaccgttgcgccgccggcgccgcgcggcggatgaagtcgagcgtctcgggcccgcctgcggccccgaatgcagcagcccgccgaccaccaccacgtagtcgaacggctcggccgcgtcgaaggtttcccatggcgtgatctggatcccgcagctcgcgcgcaccggcgcgagggtctcgccgatcacgctccatgcgcagcgcacgggcttgctgtagtcgccgtcgtccgctgacagccggagcatgtcgacgaagcccgagaaggccgtcagcgtgaagttcggcagcagcacgatgccgaagcggatgcgtcgcggtgcgggttctgcgagggggaagcgggtacgtcgggtgtcatcgcggccaatctcttcacgccgggcaggcggtctcactcagtctgtcgatacgggtaacgcgggtacggcagtcgggcacggccgggcgacgcggatgcagccagcgtcgccgatcggctccggcgcgacttgtggttttccgtcgcgaaccatcgccaaaacgcactttccggcccgccggcgcggcgcttggcggcggtatcccacgccgatgccgtttttgttctatcggccgattttacgctttgatgtactggtgcccaacgtcacttgatgtatgtccccatccagaggaagccagatgaacgtcagcgcgttcgacctgttcaagatcggcatcggcccgtccagttcgcacacggtcggcccgatgatcgccgcgtgccgcttcgcgtcgcacgtggaggacgcgaacctgctcggtttcgtgcgccgcgtgcgggtcgaactatacggctcgctcggcgcgaccggcaagggccacggcaccgacaaggccgtgctgctcggcctcgagggtcacctgcccgacacgatcgatcccgacctgatcgagccgcgcctggccgcgatccgcgcggagaaatcgctgtcgctgctcggcaagcagacggtgcgcttcgacgaaaaggaacacatcggcttctatcgcaagctgatgagcggcacgagcatcgtgcacccgaacgggatgcgcttccaggccttcgacgaacacggccagctgctcgtcgagaaagagtattactcggtcggcggcggcttcgttgtgaaccgcgacggcgatcgcgtgaacggcgtgcgcgcggcggtcgaggtgccgtacccgttccgcaccggcgacgacctgatgcgccagtgccgcgagcacgggctgtcgatcgccgagctgatgatgcgcaacgaatgcgcgctgcgccccgccgacgaagtgcgcgccgggctgctcgcgatctggcgcacgatggccgcctgcgtcgagcgcggctgcaaggtcgagggcgacctgccgggcccgatgcgcgtgaagcgccgcgcggccgagctgaatgcccgcctgcgcgcgcgttcggaagagtcgctgcgcgacccgctgtcgatgctcgactgggtcaacctgtatgcgatggccgtcaacgaggagaacgcggcgggcggccgtgtcgtcaccgcgccgaccaacggcgcggccggcgtgattcccgcggtgctgcactactacgtgaaattcgtgccgggctcgaacgaagccggcatcgtcgaattcctgatgacggccgcggcgatcgggatcatctacaaggaaaccgcgtcgatctccggcgcggaagtcggctgccagggcgaagtgggcgtcgcgtgctcgatggcggccgccgcgctcgccgcggtgatgggcggcacgcccgaccaggtcgagaacgcggccgagatcggcatggagcacaacctcgggatgacctgcgaccccgtcggcgggctcgtgcagatcccgtgcatcgagcgcaacgcgatgggcgcgatcaaggcgctgaacgcgtcgcgcatggcgctcaagggcaacggccagcactacgtgtcgctcgactcggtcatcaagacgatgcgcgagacgggcgccgacatgaagacgaaatacaaggaaacgtcgcgcggcggtctggccgtgaacgtcatcgaatgctaacgaaggaccacaacatgagccgctactcgatattcagcctgttccgcaacggtctctcgtatcacgagaactgggaaaagcagtggaagagcccggaaccgaagaaggaatacgacgtcgtgatcgtcggcggcggcggccacggcctcgcgaccgcctactacctcgcgaaggaacacggcatcacgaacgtcgcgatcctcgagaagggctggatcggcggcggcaacaccgcgcgcaacacgacgatcgtgcgctcgaactatctgtgggacgaatcggccgcgctgtacgagaaggcgatgaagctgtgggaagggctgtcgcaggacctgaactacaacgtgatgttcagccagcgcggcgtgatgaatctggcccacacgctgcaggacgtgcgtgacaccgagcgtcgcgtgaatgcgaaccgcctgaacggtgtcgacgccgaattcctgacgcccgcgcagatcaaggaaatcgagccgaccatcaacctgaacagccgctatccggtgctcggcgcatcgatccagcgccgcgccggtgtggcgcgtcacgacgcggtggcctggggcttcgcgcgcggcgcggaccgcgcgggtgtcgacatcatccagaactgccaggtgacgggcattcgccgcgaaggcggcgcggtggtcggcgtcgatacggtgaagggcttcattaaggcgaagaaggtggcggtggtcgcggccggcaacacgacgacgctcgccgacatggccggcgtgcgcctgccgatcgaaagccacccgctgcaggcgctggtgtccgagccgatcaagccggtcgtgaactcggtgatcatgtcgaacgcggtgcacgcgtacatcagccagtccgacaagggcgacctcgtgatcggcgcgggtatcgaccagtacacgggcttcggccagcgcggcagcttccacatcatcgaaagcacgctgcaggcgatcgtcgagatgttcccggtgttctcgcgcgtgcggatgaaccgccagtggggcggcatcgtcgatgtgtcgccggacgcgtgcccgatcatcaccaagaccgacgtgaagggcctctacttcaactgcggctggggcaccggcggcttcaaggcgacgcccggatcgggctgggtgttcgcgcacacgatcgcgcgcgacgaaccgcatccgctgaacgcgccgttcgcgctcgaccgcttctacacgggccacctgatcgacgagcacggcgcagccgccgtcgcgcactgaacgaggagaagaaaacatgttgctgatcgaatgtccgtggtgcgggccgcgcgccgaatccgagttctcgtgcggcggtgaagccgacatcgtgcgccccgtcaacaacgagaacatgaccgaccgtgaatggggcgaatacgtgttcatgcgcgagaacaagcgcgggctgcacaaggagcaatggctgcacgcgcagggctgccgccgctggtttaaggccacgcgcgacacggtgacctacgatatcaagggctacgaaaagttcggtggcgacgctgccggcaacgcacacgaagagggcacgagcaaatgagccagaaagaccgcctcggcaccggtggccgcatcaatcgcgcgattccgttgacgttcacgttcaacggccgcacgtatcagggcttccagggcgacacgctcgcgtccgcgctgctcgcgaacggcgtgcactttgtcgcgcgcagcttcaagtaccaccgcccgcgcgggatcgtgacggctgacgtcgcggaaccgaatgcggtcgtgcagctcgaatcgggcccgtacacggtgccgaatgcgcgcgcgaccgagatcgagctgtaccaggggctcgtcgcgtcgagcgtgaacgccgagccgacgctcgagaacgacaagtacgcgatcaaccagaagctgtcgcgcttcctgccggccggcttctactacaagaccttcatgtggccgcgcaacatgtggccgaagtacgaagagaagatccgcgaagccgctggcctcggcaaggcgccggaagcgctcgacgccgatcgctacgacaagtgctatgcgcactgcgacgtgctcgtcgtgggcggcggcccgtcggggctcgcggccgcgcatgcggcggccacggccggcgcgcgcgtgatcctcgtggacgaccagcgcgagctcggcggcagcctgctgtcgtgccgcgcggaaatcgacgcgaagcccgcgctgcagtgggtcgagaagatcgaggccgagctgcgcaagctgcccgacgtgacgatcctgtcgcgcagcaccgcgttcggctaccaggaccataacctcgtgacggtcacgcagcggctgaccgatcacctgcccgtgtcgatgcgcaagggcacgcgcgagctgctgtggaaagttcgcgctaagcgcgtgatcctcgcgaccggcgcgcacgagcgtccgatcgtgttcggcaacaacgacctgccgggcgtgatgctcgccggcgcggtgtccacctacgtgcatcgcttcggcgtgctgccgggccgcaacgcggtcgtgttcacgaacaacgatcgtgcgtaccagaccgcgctcgacctgaaggcgtgcggcgcgaaagtgacggtcgtcgattcgcgcgcatcgtcgaacggtgcgctgccggccgcggcgaagcggcagggcgtgacggtgttgagcggcgccgtcgtgacggccgcatcgggcaagtggcgcgtatcgtcggtcgacgtcgcgtccagcacgaacggccaggtgggcggcaagctgcagacgctgccgtgcgacctcgtcgcgatgtcgggcggcttcagccccgtgctgcacctgttcgcgcagtcgggcggcaaggcgtgctggagcgacgagaaggcgtgcttcctgccgggcaagcccgttcaggcggaagcgagcatcggcgcggcggccggggaattcggcctggcgcgcgctgcggctcgcggtcgatgcgggcgtggaagcggcgaaggccgcgggcttcacggccgagcagcgcccggtcgcgccgcaggtcgcggaaaccgtcgaaggcgcactgcagccgctgtggctcgtcggcagccgcgaggccgcggcgcgcgggccgaagcagttcgtcgatttccagaacgacgtgtcggccgccgacatcctgcttgccgcgcgcgaaggcttcgagtcggtcgagcacgtgaagcgttatacggcgatgggcttcggcaccgaccagggcaagctcggcaacatcaacggatggcgatcctcgcgggagcgctcggcaagtcgattccggaaacgggcacgaccacgttccgcccgaactacacgcccgtttcgttcggtacgttcgcgggccgcgagctcggcgatttcctcgacccgatccgcaagacctgcgtgcacgagtggcacgtcgagcacggcgcgctgttcgaggacgtcggcaactggaagcggccgtggtacttcccgaagaacggcgaggatctccatgcggccgtgaagcgcgaatgcctggcggtgcgcaacagcgtcggcatcctcgacgcatcgacgctcggcaagatcgacatccagggcccggatgccgtgaagctgctgaactggatgtacacgaacccgtggaacaagctcgaggtcggcaagtgccgctacgggctgatgctcgacgaaaacgggatggtgttcgacgacggcgtgacggtgcgcctcgccgaccagcatttcatgatgacgaccacgacgggcggcgcggcgcgcgtgctcacgtggctcgaacgctggctgcagaccgaatggccggacatgaaggtgcggctgtcgtcggtcaccgatcactgggcgacgttcgcggtggtcggcccgaagagccgcaaggtcgtgcagaaggtgtgccaggacatcgacttcggcaacgaggcgttcccgttcatgagctaccggaacggcaccgttgccggcgcgaaggcgcgcgtgatgcggatcagcttctcgggcgagctcgcctatgaagtgaacgtgccggcgaatgcgggccgcgcggtgtgggaagcgctgatggccgccggtgccgagttcgacatcacgccgtacggcaccgaaacgatgcacgtgctgcgtgcggagaagggctacatcatcgtcggccaggacaccgacggctcggtcacgccgtacgacctcgggatgggcgggctggtcgcgaagtcgaaggacttcctcggcaagcgttcgctcgcgcgctcggacaccgcgaaggagggccgcaagcagttcgtcggcctgctgaccgaggacgaacagttcgtgctgccggaaggcgcgcagatcgtcgcgaaggacacgcaggtgtcggcggtcgatccgacgccgatgatcggccacgtgacgtcgagctactacagcccgatcctgaagcgctcgatcgcgctcgcggtggtgaagggcggcctgaacaagatgggcgagagcgtcgtgattccgctggccaacggcaagcgcatcaccgcgaagatctcgagcccggttttctacgatactgaaggggtgcgccagcatgtggaatgaaaccagaaaccagacgcaggtggcgggcgcgggcggcgtgacgcttgaatcgccgttcgtcggcgcggccgacgtgctgaagccgcaccaggcgcgcgcatcgaagaaattcacgctgcgcgagcggccgttcctcgatctcgtgaacgtgcgcggcgagttgagcgatccggcgttcgtcgccgcgttcgagcgcgtggtcggctgccggccgccggcggcgccgaacaccgttgcccgcggcgccgagtacgacgtgctgtggctcggccccgacgagtggctcgtgcgctcgcacgggcccgtgcaggcaggcgtgctggaggcgcgactcgcggaggccgtgcagggttcgtatgcggcggccgtcgacgtcggcagcggttataccgtcgtcgagatcagcggcgaacgcgtgcgcgacgtgctcgcacgcggctgcccgctcgatctccacccgcgcgtgttcaagccgggccagtgcgcgcagtcgcactacttcaagacgtcgatcgtgctggtcccgaccggcgacgatgcgttcgagatcgtcctgcgccgcagcttcgccgactatttcgtgcggatcatgctcgacgctgccgcgccgctcgcatcatgaagccgttcgacgaaccgttcgtggcgatcgacgcgccgcgcctgcgcgggcacggctggagcgtgttcgtcgacgaactgaaggtgcccgcgcggatcggcattcatgcgcacgagcatgaagcgccgcagccgatcgtgatcgatgcccggctcggctatcgctgcgagccgagcgagcagggcgagtggatcgattacgacggttattgcgcgcgacttgccgcgttcctgtcgcacaagccgcatacgcggctgctggagacgctcgtcgccgacatcgcggtgctgtcgttccgcgaatggccggcgctggagtcgctgacgctgtcggtgtacaagccgaagatccggccgggtacgaagcgcgtcggcgtgtcgctcgactggacgcgcggggattacttgcggtggacgggggcggcggggcagctttgaaggggcggggcggagaggcaatccgcccacgcgattgctcattgttcctggagtatcggaacaatgagacgttccccgtcacttgtcacgcgagcgcttttgagcaacccactgcggacccgctccagcagcttgcggtggccttcccggtcaatgcatcgtgatgccgccctctacgagccatgcgtgcgacagtctcatcaggatcgctccgttcaacgtgacaggtggcgagcaatgaggcgttcggcctttgacggatatcgcgcggttcaccggcgatagctgcgaaacagttcaggcgtgtcgcagctatcgccccgtgtaatcgcgtcaagccgcagccgccccatccaacgccggatagtccacatacccgcgcgcatcgccgccgaagaacgtgtcgcgctgcgcgtcgttcatcggtgcgcccgtcttcagccgcgtgacgaaatccggattcgcgagcaccatctggccgtacgcttcgagatcggcaagacccgtcgcgacatccgtgccgatcgcgtcgcgcgtgcggcccggccggttcacgatcagcataccgttccagcgtgcgcgcaggtccgcgagcagcggctcgttgccctggtgcatcacgtgcaggtacgcgaggccgagccggtcgagctgcgtcgccaggtagcgatacaggtccggcccttccacgccttcgtcgatgccccacaacgtggtgcccggcgacaggcgaatcgcggtgcgatccgcgccgatctcgtcggcgatcgcctcggcaacctcgatcgcgaagcgcgcacgattttcgattgaaccgccgtaggcgtcgctgcgcgtgttcgcgttcggcgcgaagaactgctggaccagatatccgttcgcgccgtggatctcgacgccgtcggcgccggcctcgatcgcgcggcgcgcggcgaagcggaagtcgttcacggtgccgcgcacgtcgtccgtcgtcagcgcgcgcggcgcgggaatctcctgcatccctttcatcgtgaacatcggcacgcccggcgcgatcgcggaaggcgcgacgccctggcgatgatgcggcgtattgtcgggatgcgacatgcgccccacgtgcatcagctggatgaacaggcgggcgccgcgcgcatgcacgcgctcgctgaccgccttccagccggcgacgtgtgcatcggtgtagatgccgggcgtcgtcaggtaaccctggccgtcgtccgacggctgcgtgccttcgctgacgatcaggccgagatccgcgcgctgcgcgtagtactcggcggccagtgcgccgggcgtgccgtcgaacgcggcgcggctgcgcgtcatcggtgccatgaccaggcggttctgcagcgtgtagcggccgacacgggccggggtgaacaatgcgtccatggtgcgtgctcctcgagggtcgggtaacggcaccggggcggtgccgtctcgggcgcgggccgcgcaccgtgcgcgcgcctcgccgccatggacacatcatccattgcttccttttcgagataaacatggtagtttggataacattgatccattgatggagcggtgggcgtggaactgctgaacgacatggcgctgttcgtggaggtcgtgaaggcgaagggctttcgcagcgcggccgacgcgctggggatgccgaattcgacgctgtcgcggcgcatcggcgcgctggaaaaggcgatcggcttgcggctgctgcatcgcacgacgcgccggatcgagctcacggaagccgggcagctgtatttcgagcgctgcaaacgcatcgtcgacgaagcgcggctcgcgcacgagcagctcggcgagttgctggccgaaccgtcgggcgtgctgcgcgcgtcgtttccggtcgatttcgcggtggtctacctggcgccgctgatcgtcgaattcgcgaaccgctatccgaagctcacgttcgatttcgaactgacgtcgcggcgtgtcgacctggtgagcgaaccgttcgacgtcgcgatccgcatcggcgaatcggccgattcgcaactcgtcgcgcggcggctcgcgacgttccgcaatcacctgtatgcgtcgccgcgctatctcgagcgcgcgggcgagccgcgcgaaccggacgacctgcggcggcatcagtgcctgagcgtgcagcgcgtcgatgcgtggacgctgcacgacgccgcgcgggagatcgaggtgccggtgggcgggcgtttcatcgtgaacagtgtcggcatggtccggcaactcgccgtgcacgaggcgggcatcatccagatgccggcggaagtcgtggccgacgacgtggccgcgggccggttgcgtcgcgtgctgcccgactgggagggagcgcccgttccggtctacgcgatgacggaaacgcgcttgctgccggcgaagacgcaggtcttcatcgagtatctgcgcgcgcatttcgcgcaggcgtgacgggcggctgcgcggacgatcgtccgccgttcactgctgcgccggctgcggcgcgtcgccctgcgcttcccatttcttcaggatgcgcacgcgcgcctggctgaagtcgacccagcagttcagccacgcgtcgtccggaatcatctgctgcggattggcggttttgacgtagtcgcaggtgtcgctcgcgaagccgtgccagcttgcctgcgacttcgcgagctgtttcgccgcatcggggttgcgttgccgggtcttgcgttcgagcgaccggtacgcgcgttccacttcctggttgttgttgtcgacgatgcatcggcgtaccgcatccatcgtcggcccctgccgttcgcaatcgaccgcggcgaatgcggacgctgcgccgctcgcgagcgcggcgacggcgagaaggcgggtggcgtaccggatcgtgtcgcgcatgcgcggagagggagtcatggggcgggacgtgtgcgacgtactggcttattgcgcgttgcgcgccgacgtcgattcgctcaccggcaccatccgcgccttcgtttcgttcgcggctttcgcatcgtcgtcgggttcgagcacgaaccggaacgaatcgacccgctgcatgaccttcgccgcatacgcgctggatccgccgctgtagctcttcagcccggcctgcacgttgccgccggccgctttcacgtagctggagagaatccgggagccggcctcgacgttcgcattcggttcggtcaggtccttcacgttacgcagcatgccgcggtgtgcggacggcacgacctgcatcagtccggtcgcgccatgctggccgcgcgccttttcctggaagcgcgattcgatcgagatgatggcgtaaacgagtgcgggaggcagcgaatatttcgtcgcagtgacgctcacgatatcggcgagcttggcggcccgctccttcgcgacaccgaatttcttcgtcaggtaggacgtgatgcggcggtttgcttcgttcggctgatcgtcggcgttcgcgagcggcgcggaggcgacagccggcgccgatgccagcacgtcgggcgcagaggcaggcacggcgggcgtttgctgagccgatacctgttgcgcaatgccgagcgagagcacgatcagccagaaaaaccgtcgtcgcatggtcgagtgcgggaaatgggaggcgcatagtatatcggccaatcgggcaagacggtcgagtgccggctcgaatgaaagcgatgtgtaggcttgtgacgttcgcaacgatcgacgcggcgatcgttgcgtggacacgcatcggagtccggatgaccgctagttgatgatctcgccgatgccggtttcgatgcggattctcagttgctgaatgaacgccggatcgtacggttcccagtgatcgagttcgccaacgatcttcaaaggcgatgtgcttcgatacgagcgcgtcggattgcccgggaatttcttgtccgtgacgttcgggtcgttttcgaatgccccggtgggctcgacgatatagacccgcggcttgccgtcgcctttggccatttccgcggcaaggccggcgcccttgggcagggccgtgaaataaacgtgattcatcacgacgtcatcccggtaattcgatctgaagcccgccgtcagcaagtcgccgatccgcaaatccgctttcgtgccatgaaaaacgggccggtgtccaggacagccatggcttctcccttggaaaatgtcgcgatgacttctaggcgcgccgcgcgctcgccactcgcgcaatcgacccgatcgcatcgctgacgagcaccgcaagcagcccgacgatcacgccgccctgcagcacgaacgcggtattcgacgtctgcaggcccgcgatgatcacgtcgccgaggccgcgcgcggcgaccgttgagccgatcgtcgcggtgccgagattgatcacgaccgcgagccggatgccgttgacgatcaccgggaacgcgagcggcagctcgaccgacaccagttgctgccagccgctcatccccatcccgcgtgcggcgtcgacgacatcgcgcggcacgtcctcgagccccgcgatcgtgctttcgaaaaccggcagcaggccatacagcacgagcgcgatcagcacgggtttcagcccgaagccgacggccggcaccgcgagcgcgagcaccgcgaccggcgggaaggtctggccgatgtcgacgacgctgcgcgcgaccggcaggaaatccgcgccggccggccgcgtgacgaagatcccggccgccaccgcgacgatcgtgccgatcaggctcgacagcgcgaccgtgccgagatgcgcgagcgttaggtcgagcaggctcgcgcgatcgtagatgacgggcgcgccgttgtccgcgaacggtgcgaaaaggccctgcagccacatcggccgcaccagcagcacgagcagcagcgcgagcgcggcggcgcgcgccgtgaacgcggcaacgtggcggggcaggggcgaacgcaagggccgtgtgcgttgcgtggcatccggcgtcgtcatgcgggctgcctcgcgtgcgcgcggatcgcgtcgagcgtgatgcggcgcgcaccgtgtgcgttgcgtgcatcgccgtcggcgacgggcaatgcatcgacaccgcgccacagcagttccgacaccgcatcgcgcagcgtgcgcgtcgcgtcgatcggctcgccgtccgcatggccgggttcggccactgcgtcgatctgcgtcagcgcgagcaggcgcagcggccggtcgacgcccgcgacgagctgctcgacgacaccggccgccggcttgccgagaatctcggcaggcggcgcgacctgcagcagccggccgccgtccatcaccgcgatcgtgtcgccgagcttcagcgcttcctcgatatcgtgcgtgacgatcacgaccgtgatgccgaggcggcgctgcaacgcgaacaggtcgtcctgcgccttgccgcggatgatcggatcgagcgcgccgaacggctcgtccatcagcagcatcgcgggctcggccgcgagtgcgcgcgcgacgccgacacgctgttgctggccgcccgacagttcgtgcggcagcttgtccgcgaactcggccggcgcgagatggaacaggtcgagcagttcgttcacgcgcgcgtcgatgcgcgcggccggccagccgagcaggcgcggcacggtcgcgatgttgcgcgcgacgctccagtgcggaaacagcccgtgcccctggatcgcgtagccgatgccgcgccgaagctgttcgggcgcgacggtcgccgtatcgacgccgtcgatgcggatcgtgccgctggtgggggcgatcagccggttgatcatgcgcagcagcgtcgacttgccgctgcccgacgcaccgacgagcgcggtgatcgtgccgcgctgcatcgtcagcgagacgtcgtcgacggcgacgacatcgccgaagcgtttgcctgcacgttcgatctcgatcatcctgtacgccccttcgcgagcgtggtcgcggcttcgaatatgacggcggccaccagcgcgagcgcgatcgtcgggatcgcgccgagcagcacgagatcggcggccgattgcccgatcccctggaagatgaaggtgccgaagccgccgccgccgatcagcgcggcgaccgcggtcagcccgatgttctgcacgagcacgatgcgcacgccgctcaggatcaccggcagcgcgagcacgaggtcgacatgcagcagccgttgcgcgcgcgtcatgcccatcgcgcgcgccgcttcggtcacgtgcggcggcacttgtccgagcccgaccacgacgctcgacgcgatcggcagcagcgaatacaggaacagcgcgagcacggccggcgcgacgccgatgccgcggatgccgagcgcggccgcgagcggcacgtgtgcggccagcagcccgagcggggccatcatcagcccgtacatcgcgatgctggggatcgtctgcacgacattgagcacgggcatcgcgacggtccgcaccgccgcgatgcgcgcgcaggcgatgccgagcggcacgcccgcgacgagcgcggcggccaccgagccgcccgcgagcgacacgtgacggatcgcttcgcgccagaaatcgtcgctgcgcaccgcatattcgcgcatcacggagaggccgtcccaccagccgctcgcgagcggcaccgagatcgccgcgatcgcgacgacgagcgcggcgaggcgccgccacgggccgaacgcgagccgtgcgagcgcgtccgcgacgagcacggcccacgcgaacagcagcagccagacgcccgcgtcgggcgacacgcgcgcgagcatgtcgtcggcggcgacgacgtgcgtcgcggccgcgccgagcgcgtacgcgagcgtcgcgagccatgcgcagccggccgcgagccgccacgcggggcggctcgccttcatcgcccacagcgcgccgacgatccacagcgcggccagcgccgcgccctgcatcgccggcagcgcggcgaacaccgacagccccgtgccggccgcgatccggttcggccgcagcacgacgaacggcaggccgagcaccgcgacgatcgtgaggattccgatcaggatgccgaccttgtcgggtatcacgcgccgcgcggacgccgccgcgcgttcggtcatttcacgaagcccttcgctttcaggtagcttttcgcgacgccggctgccggctcgccgttgatctggatgcgtgcgttcagcgactgcagcgtcttcaggtcgaggctcgcgaacactggtttcaggtaatcggcgatctgcgggtgcgctttcagcacggcttcgcggatcacgggcgcaggcgcgtagacgggctgcacgtgcttgtcgtcgtcgagcaccgcgaggccgctcgacgcgatgccgccgtcggtgccgtacaccatcgccgcgttcacgccgtcggtctggttcgcggcggccttgatcgtcgcggccgtatcgccgcccgacagcacgacgagttgctcgggcttcagcttgaagccgtacgctttctcgaacgacggcagcgccgacgcgctgttcacgaattcggccgacgcggcgagcttcaccttgccgccgcccgcgacccacttgccgaaatcggagaacgtcttcaggtgctgcgactgcgcgacggggcgagcaacgcgacgccccacgtgttgttcgcgggcgccggggcgagccacaccagatggttcgccgcgtagtcgagcttcttcgcggcgtcgtagccctggctcgcgttcttccacagaggatcgtcggccttgttgaagaagaaggcggcgttgcccgtgtattcggggtagatgtcgatctcgccgctcgtgagcgccttgcgcacgatcggcgtggtgccgagcgcgatcttttcggtgacggggatgccgtgcgccttcagcacttgcgaaatcaggttgccgagcaggttgccttcggtgtcgatcttcgacgacaccacgacgggtgcgtcggcgtgcgcgccgggtgcgacgagggcggcggcgaacgcgaggcccagaatccgggcgggcagggcgagcttcatgagccaatctccaggacgggggcgtaggccgcacgttacttgactgggcgggctttggcaaaccgcgtgcggcggcgtgtccacagcccgcgtggggataacccgcatgagtcgcgcgggcttgttacactcgatttcgtttccgcttgccgacaattgctgacatgaaacccgagctgctggtcctcatcgcattgcgcggcgacgcgcaccgcgagatcgccgcgtcgttcgacgtgcgccatgccccgactgccgaagaacgcgaacgcgcgatcgccgaacacggcggcacgatacgcgcggtgctgaccaacggcagcacggggctcaccggcgccgagatcgaccggcttccgcaactcacgttcgtcagcgcgctcggcgcgggctacgagcacatcgacgtcgcgcatgcgaaggcgcgcggcgtcacggtcgtgacgggcgccggcaccaacgacgattgcgtggccgaccacgcgttcgcgctgctgctcgcggcggtgcgcaacgtggtgccgctcgatgcgaaaacccgtgcaggcgtgtggcgcgacgggctgccgatgccgccgaacgtgtcgggcaggaagctcggcatcgtcgggctcggcaagatcggcgagaagcgcgcgtcgcgcagccggcttcgacatcgagatcggttatcacaaccggtcggagaagaacgttccctatcgctatttcgaccgcgtcgacgcgctcgcgcagtgggccgatttcctgatcgtcgcgacgccgggcggtgcgggcacgcggcacctgatcgaccgcaccgtgctcgatgcgctcgggccgggcggttttctcgtcaacgtttcgcgcggcagcgttgtcgataccgctgctttggcagacgcgttgcgcgaagggcgcatcgcgggcgcggggctcgacgtgtacgaaggggaaccggagccgccgcgcgcgctgacggatctcgacagcgtcgtgctgacgccgcacatgggcggctggtcgccggaggcgctcgatcgctcggtgcagcagtttctcgacaacgcgaagcggcatttcgcggggcagccggtgttgacgccggtgtgatggccgcagggcgggcgcgagtcagcccgcctgtctgcagaattcccaatagaaatccggcaggttcgctggcttgccgccatcgaggtcgatccagccgaactggtcgtgctcgtcgctcaggacgatttcgtgccgatcgacccggcactcgaagcacacgatgagcacgcgcttgcccggcacgacctcgcacgagcggctcgccacgtagcggatcgccgaggcgacgattccgcattcctcccgcacttcgcgcgcgacggtttcctcgagcgattcgccggcttcgggccagccgcccggcaactcccattcgtcgtgtggattgcgcaggaacagaaccgagcgtccgtcgcggacgatggctttcgcgctgagggggatcatgaggcggcaccgttggcgttcgactttcgcagcgtagcgcaggtgtgccgttcctgctgcgatccccgcctgcgccgacgagcgcgcagacggggaggcggcgccgttgcgccggacgccggcgtgcggttacacgcctgccgacgacgacgccagcggcaccgtcaccgacgtcccggccggatcgagcgtgaggcccgtacccggcgtcggccgcagcgttgcctcgttgtcgctggacaggacgacgagccccagccggtggccggcttccagcttgtagtcacgcggcatgaacgtcagcttcaagtcgtacggcatcccgggcagcacgggctccgagcgccattcggaccaccggttgcgcgggtcggtccacgcgcgcgtgacgatcgtggccgtaccgtccggcgcgcgatcgaccagcagggccgtcacgttggccaccgccgtgaaggtcagcctgacgcgtgcggtcgcggcgccggacaggcgtgtcgcggccgtgagcggcgcggtttcgaaacggctgcgattctcgccggtcggtgcgttcgccagcgtgagcgcggtgatgcgcgcatcgtccgtgaagcgcgcgagcgggccgccggtcggcagccgcagcagcgagccggtgcctgcgccgtcgccgccggcaaagtacgtgaccggcgtggcgtggcgtgcggcccagtccgcttccttcagcagcgtgccgtccgcctgctcgatcaccgcgcgcggatcgcgttcgacgccgttgtcataaccgatcaggtaacgcgtaaaccagcggttcacctccgcggtccatgcatcggccatcgccggcacgcgggtcgggtcggtgtgcttcaggcggtgcagccacagctgcgtcggcacgccctggcgccgcatcgcgagataccacaacgtcgactggtcgacgcgcacgttgtcgtcggtcaacccttgcgcgacgagcgccggcgcgaccgcgaagccggtcgggatgtcgcgcgcggcccagaacggcgaatagtcgccggtcttgcggtcttcctgctgcaacgcttcgtcgatcaggtgcgtgcaacgctccggatgcgcgttcgtcagcagcgccttgatgtacacgtcgacgtcttcgccctgatagccttccggcgcacgcacgagcccgcccgagcggtagtagccgtacatgttcgtcaacccggcgaccggcacgatcgcatcgagcccgcgcgtgcgcaggctcgcgaccatcttcggcagcgtgccgtcgtacgacacgccgtacatgccgacgtggcccgtcgaccagttcgcgacgaccgtcttgccgttcgcgtccttcgcggtcgcgtcgcggccgagccagcggatcaccgatgccatcgcgaccgattcgtcgcgcgtgaggatcgtcgggcaaccgtccgagccggcggtgccgagcgaatccgcgtagacgatcgtgaagccgcgcggaatgaagtagccctcgatccacgagcgcccggcggcggcggcctccacctgctgcagcatccgcacctgcggcgcggcggccatgatgcgcgcggacgtcgaggcggccgcctgcgcattggcggcgggtgcggcgtgccgtcgagttcgacgtcgacgttgtggtcggggctgtcggcgaggcccgcgtagtacgggctcgcgagcacgatgacggcgtgcgcgcgccgttcgcggtttcggtcgggcgcacgatgcgcacgtggatgcggtcgcgcgtgccgtcgccgtcggaatcgaccgacgtgtcgacccacgcgttctcctcgatcgtgccgcccgacagcgacggctgcacctggccgttcgcgatcacggggcggtagcggccgccgctggccggattggcgtacgggacgccggacggcgagatgcgtgatgcgagcgactgcttgtcggccgccgatgcggcgaccctcctgttggccctgcgcgagcgccgagacgcccgccacgctgccgccgtcgtcgccgccgcacgcggcgagcgtcgtggccgcaacgagcgcgggaagccacgcgcgacgcaatccggttcgatgaatgtccattgtcgacctcttgttgtgattgtccggaaccggccggcccgcgatatgcccccgcggcccggccgggtgctgcatcggatgaaacggaactgcaccttcgaaagcgccgggcgcgatgcccgggtgtcacggccggtgtggacgcgcgtcacgcgtcgcgcaacccggcgggtgtcggggcgactgcattgccccgaccggaaagcgtcagcacggccgccggttcatgacgcgcggtcggcccgggccggcggcgcgaagtgaatggaggagtgcgaatcaaatgcgggcatgcccgatcttccttcaggtttcggatgaaacggaacggcacgatgcgatgaggcggggatggtgcgaacggcggtgctgcaacggcaggaaagcgcgacgcgagtcggcgaggcgagccggattgctttccggaagcttgcgcaaacttatctcagtgaaatcctggtgtcaaactttttagtttcagtcaaacaaagtattggcacgtgcttcgcgatcgatgtgcgatcggtctaaatttccgcgaaatttgtccgtaaacggtaaaaacggattgaaaggagagagagggcatgacgatttcagtcacggcagcgagcggccttacgctcgcgcagatggtgcaggaagccgcgctcgacgggcgtcgacaggcggacacggcggccgggaaaccgcaggacgcgccgctcgagatccgggcgctggacccggaagcgatgcaggcggcgcgcacgaagcagttgacgatcctgggcgacctgtcgacgaagctgcgcgacgtcaccagccagctcgcgacgagcctgcaggagatcatcgcgaagcgcccggacctggccgacgcgaagttcgacttcatgaccgacaacggccggatcaaggtcgtgtcgaagacgatgacggagagcgatcgcgcgtgggtggagtcgacgctgaacgcgaacgcgggcctcgtgctcgcgacgcgcgagtttcaccagcaggccgtcgacttcgccgagcagggcgccgccgcggtgggcgacacgttctccgacgacgatcgcaaggtggccagccagcgcgccgacgcggacttcctcttcatgaaggagatgaatgcgtccgtcgcgcgcaaccggaaattcgaggaggtcggcgggcatttcaccacgcaggacggcacgcggctgaacttcgacgagtcggccggcagcgcgcgcggcacgctcgcgctgctggataccgatcgtcagttgtcgtcgggtgcggcgatcttcgtcagcgacgagtcggggcagaagacgtacggcaggcgtgcgggcctgatcgacgtcggcttcgggaacgcgttcgaggacatcctgaacggcacccatagcgtcggttttcacgagatggcatgacggcgcaccacgccgcgccgaagcgccgcgcgcctattcgtcgcgcagcgcttcggccggccgtaccgcgcggcgcgccagctcgggtagagcgtcgcgacgcacgacatcaggaacgcggccgcggcgatctcgatcacgtcgatcgccgcgagcttcgacggcagcgaactgaggaaatacacggacggcgtcaggaagtggatgccgagcaaccgctcgaccgccggcagcacccacggaatgctcaccgcgatcgcgcagccgagcgcgacgcccgccagcgtgccggtgaggccgatcgtcatcccctggatcgcgaagatcttcatgatcgacccgggcggcgcgccgagcgtgcgcaggatcgcgatgtcgccctgcttctgcgtgacggtcatcacgagcgacgacacgaggttgaacgcggcgaccgcgacgatcagcatcaggatcagcgacagcatgcgctttgcagccgctcggcctcgaaccacgtgcggttctgccgcgtccagtcgcggatgtagagatcgcccgacagcgagcgcgacagttccagcgcgacgtcgggcgcgcgctgcaggtcgtcgaggcgcagccggatgccggtcggcgcgcgcacgttgaacagcgtctgcgcgtcgcggatatggatgtatgcgagcgcgctgtcgtactggtagtggcccgactcgaacgtgccgaccacgttgaactgccggaactgcggcagcgcgtcgccgatgcgcgcggtgttgccgggcgcgaagaacgtgatgcggtcgccgatcttcacgtgcagcgcgtcggccagcgccgagccgagcacgatgcccatcccgcccggcacgagcgcgtcgagccgccccgtcttcggcttgcgcgcgatctcggacacgcgcggctcgagcacggggtcgatcccgcgcagcgcgacgcccgtcacgctgcccgcgttcgtcagcagcgcctgcgcgtcgacgtagggcgcgacggcgcgcaccgccgggttccgcagcgattcgtgcgcggtgagccgccagtcgggcatcgcgccggtgggcgagaagatttccacgtgcgcgagcaccgacagcatccggtcgcgtacttcggtccggaaaccgttcatcaccgacagcacgacgatcagtgccgcgacgccgagcgcgatgccggccatcgccgcgccggcaatgaacgacacgaagccgtcgccggccgagcgccggccgccgcgcgcgtagcgcagcccgatctgccattcgaacgggagtttcaagcggattcctttcatttcgattcgattcgtgccgagccgcgcattctagcgaacgcggcgcgggtgcgcgcagcggttggggcggcgagccgaaatcccgcccgaccggacggtcgacggccggcgttgcgcgccggcacaccgatatttccatcgtttcgggtctgatcgataatggcggccagcatccggtcgaacacaacattccaagcattccggcgcaaccagggccgcgccgtcacagaccaataaatctcgggaacgccgccgaagccggccgcacgtccttgaacaaggaaataacaacatggatttgctgcgcttcctgctgctcctgccgattcgcgtggcgggcttcgtctggtggctgctcggctgcgcgctgcggccgctggtcggcgacgtgtcgtggacggcgcccgcgtggatgggcatcaccgccgcggccgtgcgccgccgcccgtggcacgccggcggcatcgtgctgctcgcggccgcgctcggctacggcggttactggttcaagcatcggccgaagccgccggagcccgagaccgtcacgttcaccgtgaaggcgccgccgatcaccacctatgaggtggacgacagcgacaagccgaagatcaccgtgcatccgctcgacgtcgtgttctcgcaatcggccgcgccgatcgagcaggtcggcaagccggccggagagggcatcgagatgacgcctgcgctcaagggcgcgtgggcgtgggtcgacgacaagacgctgcgcttcacgccggcggccgactggccggtcggcgcgcacgtcgaggtgcgtttcgcggtgcaccgggtgttcgcgccgcaggtgacgatgcacgacgaccgcttcgcgttcgatgtgcccgcgtttgccgccacgttcggcaacaacgagttctatcagaatcccgacaatccggcggagaaacaggcgctgctgcagctgcgcttcaactatccggtcgatccggccgaattcgagaagcgcatcggcctcgtgctggtcggccgcgacggcaagaatgcgacgccgctgcgctacacggtcaactacgacaagatgaagacgagcgcgtgggtgtattcgcagccgctcgagattccgcgcgatccgctggtcgcacggctcgacgtcgacaagggcgtgaagagcgcgcgcgcggcaacggtacgcccgacgtgctgcacgcggcagtcgacgtgccggggctctacagcctgtcgatcgacaacatcgcgccgacgctcgtcgacaacgagcgctacgagcccgagcaggtgctcgtcgcggaagcgtccgacggcgtgcgcagcgccgacctcgcggcgcgcgcgaaggcgtgggtgctgccgaagcgcaagccgggcgtcgatcagtcggacgacgatccgccgtacgaatggaacgtggccgacatcagcgatgcggtgctgaagcagtcgaagccgctgccgctcgaggcggtgcccaccgagaacgatttcgcgacgctgcagagcttcaagtaccacgcgacgccgggcgagcgcgtcgtcgtgcggttcgagggcaacctgaagtcggccggcggctacctgctcggcaagcccgtgacgaccgcgttcacggtgcccgactatccgaagctgctgcgcttcatggccgacggttcgctgctgtcgatgagcggcagcaagcggttgtcggtcgtgtcgcgcaacctgccgggaatgaaggtcgagatcggccgcgtgctgcccgaccagctccagcatctcgtgagcttcaacaacggcacgtacgcgcggcccgagctgtcgtattcgttcagcgaggatcacatcgtcgagcgcttcgtgcagacgcgcgcattcccggccggcgaacccggcaaggcgcattacgaaggcatcgatctcggccagtacctgaagggcggcaagcgcggcgtgttcctgctgcacctgacgaagtacgatccggccgccgagaagaagaaagccgatgacgcgaaggacggcgatgcatcgtccggcgacggcagccaggatcagtccgacagcgccgactcaggcgacagcagcggaaacgacaacgacagcgacagcgcgctcggcgatacgcgcctgatcgtcgtgaccgatctcgggatgctggtcaagaaggcgctcgacggcagccaggacgtgttcgtccagtcgatccgcaacggccgtccggttgcgggcgcaacggtatcggtgctcgcggtgaacggccaggcgctgttcacgcagacgacgggcgccgacggcatcgtgcatttcccggcgttcaagggctcgaccgcgagaagcggccgcagctgtacgtcgtgaagaaggacaccgacctgtctttcctgccggtggccggccgcgatcgccagctcgacttctcgcgtttcgacgtcgacggcgagcgcaatgcgacgggccaggggcaactgtccgcctacctgttctcggatcgcggcctgtaccggcccggcgatccgttccacatcggcctgatcgtgcgtgccgcgagctgggcgcgcagcccggccggcgtgccgctgcaggcggagatcgtcgacccgcgcgggatcacggtcgagcgcaagccggtgacggtcgatgcgacgggcttcaccgagctcggctatacgacggccgaaacggcgccgaccggcacgtggacggtcaacctgtacatcgtcaaggacggccagcccggcgcggagccgatcggcagcacgacggtgcaggtgaaggagttcctgccggaccgcatgaaggtcgacgcgaagctgtcgcagcaggtcgtcgaagggtgggtgaagccgaaggggctgaagggcgtcgtcgacgcgcagaacctgttcggcacgccggcggagaagcgtcgcgtcgcggcgacgctgacgctgcgcccggtgtggccgtcgttccgcagctggcagggttatcacttcttcgacgcgcgccgcgcgaaggagggctacacgacgacgctgcaggacggcacgaccgacgagcacggtcatgccgaattcgacctcgacctcgacaagtacgcagactcgacctaccagctctacttccaggcgaaggcctatgaagcggaaggcgggcgcaacgtcgccgcgaacgcgcaaacgctcgtgtcgaacaacgactggctcgtcggctacaagtccgtcgacgatctcggctacgtgaagcgcggcagcccgcgcacggtgcggctcgtcgcgatcgatccgaacgcgaaggcgatcgacgtgaagggcctgcgcgcgcagctggtcgaggagcgctacgtgtcggtgctgaccaagcaggattccggcgcatacaaatacgattcgcggctgaaggaggtgcccgtcgacgagaagccgctgacgattccggcggccgggctcgacttcacgctgcgcaccgacaagccgggcagctatgcgctcgtgatccgcgacgcggacggcgccgcggtgaaccggatcgagtattcggtcacgggcgacgcgaacgtcacgcgttcgctcgaccgcaacgcggagctccaggtgagcctcgcgaagcacgactacaagccgggcgagcaggtcgagatcgcgatccgcgcgccttacgcgggcagcggcctgatcacgatcgagcgcgacaaggtgtatgcgcacgcatggttccatgcggacacgacgagctcgatccagcacatcacggtgccggccggtttcgagggcaacggttacatcaacgtgcagtacatccgcgatccgtcgtccgatgaaatcttcatgagcccgctgagctacggcgtcgtgccgttctcggtgaacctcgatgcgcgccgcaacgcgctgtcggtcgatgcgccggcgctcgtgaaacccggcgacacggtgaatttcaccgtgcattcggcgaagcccgcgaaggtcgtcgtgttcgccgtcgacgagggcatcctgcaggtcgcgcgctacaagctcggcgatccgctgaagttcttcttccgcaagcggatgctcgaagtcggcacgtcgcagatcctcgacctgatcctgccggacttcgagaagctgatggcgatggccgcgccgggcggcgacgccgacgatgcgatcggccgtcagttgaacccgttcaagcgcaagcgcgacaagccggtcgtctactggtcggggatcgtcgacgtgaacggcgacacgcgcctgagctacacggtgcccgactatttcaacggcaagctgcgcgtgatggccgtgtcggtgtcgccggacctggtcggcacgttcgagggcgcgacgacggtgcgcggcgacttcgtgctgtcgccgaacgtgccgacgacgctcgcgccgggtgacgaggccgacgtcagcgtcggtgtctcgaacaacctgacgggcgccggcaaccagccggtgccggtcgcggtcacgctgaagacggggccgcagttgcaggtgatcgggccggccacgcagaacgtcgcgctcgcaccgcagcacgagggcgtcgcgatgttccgcgtgaaggcgaccgatacgctcggctcgggcgcgctgtcgttcggtgcgcgctacggcgcgaagggcgcgcagcagcgcgtcgacgtgtcggtgcggccggccgccgcgttccgcacgcagctcgacatcgcgcggctcgacccgggcaagaaggcgagcgtgccgaacctgcggtcgatgtacgacgcgtatgcgtcgcgcgacgcgagcatctcgaccgcgccgctcgtgctgtccgaaggggtggcgtcgtatctcgtcaacttcgagcactactgcagcgagcagatggtgagcgcggccgtgccgcgcgtgttcgcggcgaagtggctgtcggtgcgcgcgctgacgagcgcgatgcatgcgaccgacgccggcgccgacacgacgaacgcggcggcgatcgcgcagttcctcggcgtgctgcgcggccggcagaacgcgcagggcgggttcggcctgtggagcgcgacgcccgacgccgatccgttcgtgtccgcgtacgcgatgcacgtgctgctcgacgcgcgcgagcgcggcatcgccgtgccgaaggacatgctcgacgcgggcaaccagtatctgcagaagctcgcggcgaacgattcgctcggctcgctcgacctgctgcgccagcgcgcttacgcggtgtacttgctgacgcgccagggcaacgtgacgaccaacagcctcgcggccgtgcagaagcggctgcaggatgcgtatccgaacgactggaagaacgacctcgcggccgcatggcttgccgcgtcgtaccagctgctgaagcaggacaaggaggccgcggcgctgatcgcgggcccgcaggcgctgctcgagcgcaagcgcgcgtccgacggcggttacgtgaccggctactacctcgatccgttgacgcgcgacgcgagcgtgctgtacctgatcgcgaagcacttcccggagcgcgtgcgcaagctgtcgccgcgagcgatggacaacctcgccgcgccgctcgtcgacaaccgctacaacacgctgtcgtcggcgatgacgatcctcgcgctcgatgcgtatgcggcgtcgagcgcgggccagctcgaccagctcgcgatcgacgaggtgcgcgcgggcgccgcgccgaaggacgtgtcgtcgatccaggcgaacctcgtgcgttcgggcacgtgggcggccggtgcgtcgcgcgtcgacttcgtgaacggcagcacgctgcccgcgtggtggatcgcgagccagtcgggctacgaccgcggcacgtcgacgaaggcgatcaggaatggcctggagatcgtgcgcgactacaccgacacggacggcaagccgctcgggaagatcgcgctcggccaggagatcgacgtgcacctgaagatccgcgcgaccggcccggcgaacgtcggcaacatcgcgatcgtcgacctgctgcccggcggcttcgatccggtgatcgcgccgccgcccgtcgccgacacgcaggacggcgacagcgacggcggcgcgtcggcgccggtggccgatgcgccgtggcgttcgccgatcggcgtcaagggctccacgtggcagccgcagttcgcggacgtgcgcgaggaccgcgtggtgatctacggcaccgcgacgaccgacgtgcgcgagttcgtctaccggatcaaggcgagcaacgcgggccgcttcgtcgcgccgccggcttacggcgagtcgatgtacgaccgccgcgtgcaggcacaggcacccggcggcacggcgctgaccgtggagcgcgtgcgatgacaacgccgctgcaacggccgtgccgggtgcgcggagcgcccgcgcgtggctgacgccccggtgctgcggcgcgctgcgcggcgccggccgctggctgcatcgctggcagaactggatcgccggcgcgctgctcgtattcggtgcgctggccgcgtgccggctgtggccgcatccgccgctgcacgactggaagccgtcgtcggtcgcggtggtcgacgcacagggccgcttgttgcggctcacgctggcgaaggacgaccgctaccgcctgtgggtgccgctcgaccggatgtcgccgcagctcgtcgaggccgtgatgctgcacgaggaccgctggttccgctggcatcccggcttcaacccgtacggcctcgcgcgcggtgcgtggatcacgtatgtgcgcggcggcaatccgcagggcggctcgacgctgacgatgcagctcgcgcgctcgctgtggcggctgaacacgcgcacgccggcgggcaagctcgagcaggttgcgcgcgcggtgcagctcgaactcttctattcgaaacggcagatcctcgaagcctatctgaacgatgcgccgtacggccgcaacgtcgaaggcgcgggcaccgcgagcgtcgtgtatttcgaccggatgcccgatgcgctgacgctgcccgaggcgctcgcgctcgcggtgattccgcaggacccggcgcggcgcgtgcgcggcgggcaggacgagatcaaccgtgcgctggccgcgtcgcgcaaccggctgtatgcgcgctggctgacgaagcatccgggcgatgcgtcgctcaagccgctgttcgcgttgccgctggcgatgcggcccttgtcggccctgcctttcgacgcgccgcacgcggtcgaccaggcgctcgccgcacgcagcgcgtggcgcacggcctcgggcggtgcgccggacgacggcgacggcggtgcgcggctcgtgacgacgctcgatctcgacctgcagcgcacgctcgaacggcagatcgcgcgttatgtcgcgcgcaacgacacgcgcggcgtgcgcaatgcggcggccatcctcgtcgatacgcgcgacatgggcgtgaaggcgctggtcggttccgcgaacttcttcgaccgcacgatcgacgggcaggtgaacggcacgctcgcgcggcgctcgccgggctcgaccctcaagccgttcatctatgcgctcggtttcgaccagggcgtgctgcatccgcaaacggtgctgcgcgacgtgccgaccgcgttcggcccgtatgcgccggagaatttcgacgggcattttctcgggccgatcaccgcgaccgacgcgctgaaccgcagccgcaacgtgccggccgtgtgggtcgcgtcgcagctcaagtcgcccgacctgtaccggttcctgcaggaagccggcgtgcgccggctcgcgagcgcgcagcactacgggcttgcgctcgtgctcggcggcggcgaagtgacgatgcaggatctcgcgggcctctacgcgatgctcgcgaatcgcggcgaattccggccgctgcggctgcgcgcggacgaaccggcgccgcccggccggcgtttgttgagcgcggaggcgagctacatgacgatggacatgctgcgccagcatctgcgccccgacgaaacgagcggcgcgcagccgtcgagcgtgcccgtctactggaagaccggcacgtcatggtcgttccgcgatgcgtggacggccggcgtgttcggcccgtacgtgctggtcgtgtgggtcggcaatttcgacaactcgaccaatacggcgttcgtcggcgtcgacgcggccgcgccgctgttcttccaggtcgtcgacgcattgaatgccgagcgcacgctcgtcgagccgccgcgcgcggtgccgccgcgcctgaagcgcgtgcggatctgcctcgcgagcggcgacctgccgaacgagtggtgcccgcagcagggctggacgtggttcattccgggcacgtcgccgatccgcgtgagcaccgtgcaccggccggtcgtgatcgacgacgcgacgggaaggccgcgtgcccgccttacgacggcaagcgcacgcatacggagatcttcgagttctggccgtcggatctgcagcaggtgttcgtgcaggccggcattgcgcgccggcggccgccgcagaacgcggagtgccgcgacgcggggcaggtcgacggcgatccgccgcgcatcacgtcgccgctgcgcggcagtacgtatgcgatgcgcgtgaagagcacggaggagacgcgcatcgcgttcaacgcgacggccgatgcgagcgcgcatgcgctgtactggttcgtcaacgatgcgttcgtcgggcgcagcgtgccgggcgatgcgctgttctggcagccgcggacggccggcagctatacggtgcgcgtggtcgacgatcacggccgcggcgaccagcggccgctggcggtggggctcgaacagtaatggacgacggcctgccggtgcaggcccgactcagacgctgtagccgatccgcagcacgccccattgccgtccgccgacgacgatgggtgcggagacgtccttcatcagcgcgaagttgccgttgcccatgtcgcgccgataggtctgcagcaggaacggcttggtatgcgacacggaggtgcgcgccgtgcggtccgtgtagatccggcgatttcggcagttcgcggcgttccacgccgcgtccgcgcgctggggcagcgagaatttccggttgtgggtcggcaagtagcactgccggtcgaagctcgcgcaatagacgatgcgcgcgtcgatcccgagcaccggctcctggatggccggcagcacgcggtcggtgaagtcggtgaagcgcgtcatgaactgctgcggatcggtgccgggaatcggcacgtagtgcgcgtcgaagagcgcgtcgagtgcgatctcgccgcgcccgaccgcttcctcgaagagcttgctgatcgcggcggccgtgtgccgcgcggtgtcgatcaggcgcgtgtcgggcgattcgatgccggtcgcggccgtgagttcgatgagcgtctcggagacggagagcaggttgccgagccggtccttggcctgcgagaagttgtcgctcgaatcctctacgccggatgccatctcgccgacctgttcgtcgagccggtggcattgcgtctcgatttcgtccgtcagcgacgcgatctgctcggcctcgccggcgagctcggtgatcgcgtgcccggtcgcgtgcacgacctcgccgatcgtacgcgtgccctcgcgcacgcgatgcgcgcgggcggcgttgtcggtgccttccgcgatcaggtgttcggtctgctcggcgaggcgcgcgagggtcgtctcgatctgggccgtcgcctgtccggtcttcgcggacaggttcttgacctcggccgcgacgacggcgaagctgcggcccgaatcgccggcgcgtgcggcctcgatcgcggcgttcagcgcgagcaggtgagtctgtcgcgcgatcacggagatctcctcggacacggcccgtacatgatcgagcgcgtcgcgcagcgcacccatctggttgccgatcgacgtgacgccttcgacgaggccgtggatgtcggcgagcgacgcctcgatcgtctgttgcgactggcgaaccgcgtccgacgcattcgcgctcacggcgcgcacctgctgcgccgcttcggcaatccggtggttgccgcgcaacgtgacggcggccgattcgcgcagcgtgtggcagacctccgcctgtctggcgacgcgggccgcgacttcctcgacgtgacccgacacgtcgcagatctcgatgccgagcttgccggcctgctcggcgatgtcgccgacgagcgcgcgcgacgaacggtggccgcggccgattccgaagaagttcacgttgcggggtctccttgaagggacgcgtgcctggtcatcggcggatgctgggcgtgcgctcctgtcttgacggcagcgagggcacggacttgaggtcgggtaaacatcgagaccgggatcgggatggcggatcgtccggccggtgccgcgcgttgcctgccgttcacggtttttgcggcgtttgcggcggccgtgttccggcgccgggccggacgggcgcacgcgggctgcccgtccggccggacgcgtcgcgccgcgtcagaacacgtggtggatgccggcgttgacgccgaccgtcgtgcccggcaacccgaacagcgcgccgcccgtgatgccgaggcccgtattcatcgcgccatggttgttgacgacaccgacctgcgcgtacaggcccgttcgcttcgacacgctgtagtcggcgccgatcgcggcgagcagcgaatgattgtgcgaatcgttgcgatcgatcgtgtaccacgcgccggtgttcaggtcgagggccggcgtgacgcgatagtcgaggccggcgctgtacacgttgttgctgaacgaaccggcaaccttgtagctcgtgaacgacgccttgccggtcacgggcccgaacgtgtaggcggtgccgatcgtgcggccgacgaacgcgaccgtgctcgataccggcgtcggcgacgtgccgccgttgccgtcgtagagcgccgcgttaagcatgaagccgccattcgcatacgtgaggctgccggaatactggcgtcccgcctggaagtccccggcttttccgccgaagccgaacatcgcgctgcccgtgagcccggcgattgtcgggctcgtgtacgaaatcgcgttcgggttgaagaggccggtgacgagcacgttgtcgacgtacgggatcagcgcggcgccgaagtgcgaaacgttgcgcgggtccgatccgagcaccgcgagcacgaacggcgagaactgcaggccgatcttcgtttcgccgaacccgccgtcgatcccgacccacgcctggcggccgaagaagttgccgttcgaatggccgaacgccccgtcggtgatgttgaagccgctctcgagcttgaatttcgcgtgcagtccgccgccgagatcctcggtacccgtcaagccgaagttggtcggtgtcatgccggtatcggtcagcgcgaactggcggcccgcattgccgccggtcgccgagtcgagcgaccggctcgtgtaaagcaacgcggcgtcgaggtcgccgtacagcgtgacgctgctctgcgcgaaaacgctcgtgctcgccgccgcgccgagcagcgccgcgcaaatcgtccgtgtcgtgatcttcatcgtctgtctccgttttgttgaatgttgtaatacgtatagctaattaatattgcggcggcggaatcgacgcgtgccgcctgcaggccgtgccgtcgggaacgcacggcgatgcttcgcgagggccggaatgcgaccgcatcccggcaccgcgacgaagcgaaacgctccgcccgggcgggcggtgttacagcgaacggttcaattgctcgaggatggccgggttctcgagcgtggacgtgtcctgcgtgatcgcttcgcccttggcgagcgaacgcagcaggcgccgcatgatcttgcccgagcgcgttttcggcaggttgtcgccgaagcggatgtccttcggcttcgcgatcggcccgatctgcttgccgacccagtcgcgcagcgtcttcgcgagcgccgcggcctcttcgccttccggacgcgcacgcttgagcaccacgaacgcgaccaccgcctcgcccgtcgtgtcgtcaggacggcccaccacggccgcctcggccaccagctcgtgcgagaccagcgccgattcgatctccatcgtgccgagccggtggcccgacacgttcagcacgtcgtcgatccggcccatgatcgtgaagtaaccggtgtccttgtcgcgcacggtgccgtcgccggcgagatagagcgtgccgccgagttcctcggggtaatagctcttcttgaagcgttccgggtcgccccagatcgtgcggataatcgcgggccacgggcgcttgacgacgagaatgccgccttgcccgttcggcacgtcctggccggtttcgtcgaccaccgcggccatgatgcccggcagcggcagcgtgcacgaaccgggcacggtcggcgtcgcgcccggcagcggcgtgatcatgtggccgcccgtctcggtctgccaccacgtatcgacgatcgggcagcgctcctggccgacgtgcttgtgataccacatccatgcttccggattgatcggctcgccgaccgtgccgatgatgcgcaggctcgacaggtcgtagctcttcggatgcaccttgtcgtcggcctcggcggccttgatcagcgaacggatcgcggtcggcgcagtgtagaacacgctgaccttgtggtcgccgatcatcttccagaagcggccggcgtccgggtaggtcggcacgccctcgaacacgacctgcgtgccgccgcaggcgagcgggccgtacgtgatgtacgtgtggccggtgacccagccgatgtcggccgtgcaccagaacacgtcggtgggcttccagtcgaaggtccacttcatcgtctgcgcggcccacagcaggtagccgccggtgctgtgctgcacgcccttcggcttgccggtcgagcccgacgatacaggatgaacagcggatgctcggcgctcacccattccggctcgcaggtgtcggattcggcggccgtcagttcgtgcatccacaggtcgcggtcggcatgccagtcgatcttgccgccggtgcggcgatagacgatcacgctcttcaccgcttcgcagccgcccagcgcgagcgcctcgtcggcgatgctcttgagcggcagcgtcttgccgccgcgcgcctgctcgtcggccgtgatcagcgccgtcgcgccgacgtcgacgagccgctcgttcagcgacttcgcggagaagccgccgaacacgaccgagtgggtcgcgccgatgcgcgcgcaggcctgcatcgcgacgatgccttcgatcgacatcgggatatagatgacgacgcggtcgcccttgccgatgccgcgcttcttcagcgcattcgcgaaacgcgacacgcgggcgaggagatccgcataggtgacgcgcgtgacggtgccgtcgtcggcttcgaagatcaccgcgactcgctcgccgttgccggcttcgacgtgacggtcgaggcagttgtacgacgcgttgagctcgccgtcgtcgaaccacttgtagaacggtgcgttggactcgtcgagcactttcgtgaacggcttgtgccacgcgaggccttcgcgcgcgaggcgcgcccagaagccttcgtaatcgcgctcggcctcggcgacgagcgcccgataggccggcatgccggaaatggtcgccgcctgctcgagcgtcgcgggcggcgcaaactggcgggtttcgtgaagaaccgattcaatcgtggacaagcgtgtctccatgcgttcttgggatgcagggctgctgttcgggaaaacgcaacatgcatgccagcatcaacgatcgatgcgcgcattcggcggaagtcgcggcgcaccgcgcgcgtttcgagcgatccggtcgaacgggcgacggggtggataccgtcaagccgaagccggccgttcataaatgcagcacatcgtgttgcagtcctcaacaggtgacgcgtgccggggaaggtggtcggccgctcgatccggagcgcggtgaggcgacctggcggtgtcaggcgatcagcgaccgaagcgccggtgcgtgcccgaactgtctgatccgttcgagcgccgacacttcgatctggcgaacgcgttcggcggacaggttcagttgccggccgatctcgcgcagcgaatactcgctttcgacgtcgatgccgtacctcaagcgaagaatccacgcttcacgtgccggcaggcggtcgatcagcgccgcaaccgccgcgcgaagctggcgggcgctcgcggattcttccggggtcgatgcggcgtggtcgatcgcgacgtcgcacaacgtgaggtcgtgatcgggcgaaacgggcaggtccgcagagatgggctcgcgcacgatacccatcagatcccgcaccttgtcgaccgggatccgcatctgcgtcgagagcgtcggggcgccggcaacctcgccggttcgttgcgcatgcgttcgcgcgaggcgcgacagcttgttgatcgcgtcgaccgtatgcgcgggcacgcggatcgtgcggccctgatcggcgatcgcatgcgtgatggcctgccggacccaccaggtcgcatacgtcgcgaatttgaagccgcgccggtgatcgtagcgatcgacggccttcatcaggccgagattgccctcctggatcaggtcgagaaactgcaggccgcgatcgggatagcgcttggcgatcgacacgacgagccgcagattgctctggaacagcttcgttctcgcgggctgcattgcgcgctcgatacgcgacagtcgcgcgtcgatcgcgatcgcgatgtcgagcggcaggctcgactcgccggcgaggccggcgagcgcggcgcgtgcttcgatcagcgccggcgcgcggcgggtgagggcagcggcacagccggcatgcgcggcgatgcagtcggtcatccatgcgcgcacgtcgtcgcacggcatgaagaggtcgcggcgcggcgaatcggtgcgtatgcccgattcgaccaggatgtcgacgatgcgctgttcgaacttgcgtgcttgcgtcgcacggtcgcgaatcgcgcggccgatgcgttcgatcgcacgcgcggtgaagcggatcctgccggtcgacgcggcggcctcgcgaagcagcgcccggtaaccggccgacgcgaaaccgccggtgcgcaatgcgtgctgcatcccggtggccagcgcgccggcgcggtcgagcgatgcgacgacgctgtcgcgccatgccgggctgtccggcgcgcggtccgtgtcgtcctcccctcgggtgattccacggtcgaatcaggcgccgttgcgttgccgggcgattcccgggtaaagccgcgggcgcttcgtcaagcgattcgacgtcgccgacgaaccccgtcacgtagaccgatgccgccaccttgccggcgcggatgtcgccggcgatcgaagcgacggcgtcgagcgcagccgggtcgcggctcaatgcgtcgatgcacgccgcgcgcccgttttccagatgaagcgcgagcgcgatctcttcttcgcggtcgagcaacggtgtcgcgctcatttcgcgcaggtagatgcggacgggatcgctcgtgcgggccgcgagcagatcggcggtcgcgagcggggccggcgcgtcggcgagcggcgacgtcgtgtccgtcgctcgcgcgaaatgacgatcgagcgtccatgcgcttcgcgagtcgacgtgctcgcgtacctcgattccccattcgccgagcatcgacgcggcggcgtcgaaatccgcgctgtccgcggcatcgtcgggcagcgcgtcgacgatttcaccgcgcgtcacgtagccgcgcccgatgcccagcgcgaccagcgcattcaaacggtccgcgcgctccgcgttcgtgccgccgcgcggcacgccgtcgtgttcgcgcccgcgcccgggatcaagcaagctttgcatagacgttgcaccagccttcggcggcaaccgccttgccgccgaacatcgggcacgtgccggaggattcgccggcgacggccttgtagaagcggcagttcgagcacgtctggccggcctggtacttcgggaacttgcctgtatcgacggtcgtcgccttcgcgcggtagccgagcgtcttcgcggccgcgtcgttttcgtcgacgagcggcgctgccgcgaatgcgccggttccggctgcgagtgcggcacacaggccggcggtctgaacgatgaaggttctgcgagtgcgggagatcatgtcgttttcctgaataaaaaccggccccgcgcgccgggatggcttcccggcgcggcggtcgatcgaagcgaagggagaaaaagcgttatttgcgcgggccggcgacgagcggcgccttcgacgaggtggcgacatcggcggtcagcttgctcttcgacgcgtcataaccgttcgaatagagcaggaacgccatcaggtcctcgtattcctgcgccgtcatcttgccggggcgatcggccggcatgttgttcgacatgtactggaagatgccgccgaccgtgatgtgcgacttgccctcgggcgcgaaggattcccgctcagcgcaggggcggtattgccttcgagctggtcgccgtggcatttcgcgcaggcatcgatatagagcttcttgccgtgctgtgcctgcgcattgtcgaacgacggcacgccgttttcgtcactcgccgagaccttgatgaagccgcccgtcgcgggtgttccgccggcgagcagcacgccggtgcgcgagtgcccggccgacgcgaccgcgccgtcgaggaagcggccgcgcgacggcgtattggccgcttgagcgatgttttccggcaggttccagccgcgtgtgagcgcggcgatccggccgttggcattcagccgcgacaacgccgcgtcgatgcgctgccgcagcgcgtcccgatcggggccgaacgcgaacgcgagctgccagtccgagtacggcgacgccgtggccgcgatccggaacggctggccgggatgcgcgcgccggtacgccacgacgctcggataccagacgatcgcgcgttgtgcgcgaccggtcgcgagcgcgtcgatggtctgctcggacgtgttctcgagatcgaagcgggcattcgtcgcctgtgccgcgatcagttgcgacgggctcgagtacgtggccgcgatcgtttccttgccggtggacgatgcatgcgcgtcgcgcagcgtcacgctgacgtagctggagcgcagatatccctgcgagaaacccatccgggcattcgatgcgtcggcgatcgccgagcgcgggaagccggcgatcatgtcgcagtcgcgttcgagcgattgcttcagttcggcggcggagatgccgtcgtcgccgccgtcgtcgtccacgccgcgccggttgaacgaggcggcgatgccggcggttcgcagcacttcacgtgcgaccgacatgtcgagggcggcggtcgggctgcccggcagcgtgcagacgcgcacgccgccggccgcggcggacatcggggtcagcgccacgcccgcggcgagcagactggcgagggtcagggagcgagtcgagttttcatggtcgtgcattccggttgaaacagtgggggcgtcgcgcccggatcgggcgcatgccgggcgcgacgcgcgttcagtcgagcgcgaatacgtagagcgtgccgccgcgcggaacgtctttcgcgacgtcggccatcgggccgccccagatcgggttcgcgccgccgtatccggcgagcaccgcgacatattccttgccgtcgacctcgaacaccgacggctgcgcgatgatgccgctcgcgagctgcgggctctcccacagcaccttgccggtcgccgtgtcgaaggcatacaggtggccgtcgagcgagccgctgaacgcaagaccgctcgcggtggtcgcgacgccgccgttccacggcttcttcgaccagtggccccacagtttcttgccggtgttcacgtcgatggcctgcagttcgccataaccctggctgcccggttcaggcttgatctcgaagccttcccgagatacggcaggccttccatgtagctgaccgacttgccggacaggctcatgcacgcgtgaagggaaggtacgaccgcgatgtggcgcgcggggtcgtaggacaccgaccaccagttcttgccgccgaggaagctcgggcacgtgtcgatcgtcgtgccggccttcgggaacttcgacgggtccgcgatgggcttgccgtcggccgtgtagccggtgaccgacgttgccgtgacgaacggctccgcgtagatcagcttgccggtcgtgcgatcgatcgcatggaagaagccgttgcggtcggcgtgaatgatcgcgtcgtagtccttgcctttgtacttgatgtccgcgaggatcggcgtgttgacgccgtcgtagtcccacgtgtcgttgctcgtgtactggtagtgccacttcaggttgccgttcttcggatcgagcgcgagcagcgagtcggaatacaggttgtcgccgggacgcagcgccgcgagccacgggccggggttgccgacgccccagtacagtgtgcggcttgccgcgtcgtacgtgcccgtcagccaggcggcgccgccgccgtgcgcctgcatcccgtcgggccaggtgtccgcgcctttttcgccggggctcgggatcgtgtagcgcttccagaccagcgagccgtcttcggggttcagcgcggcgatgtacccgcgaatcccgtattcgccgccggaggtgccgacgatgatcgagccgtccagcgcgagcggcgcgagcgagaacgcataaccgaggcccggctcgaacatctgcttcttccagacgagattgcccgtctgcgcgtcgagcgccacgacctcgccgctcagcatcgcgacgtagacgttcttgccgtacagcgcgacgccacggttgacgacgtcgcagcatgcggtcttgaacgatgccgcgccaagcttcggttcgtatttccacagctgcttgccgctcttcgcatcgaatgcgtagacgttgtccttcggcgtggtcacgaacaggtagttgccgttgatgatcggcgtggcttcgaagccctgcttcagctcggcggggaacttgtaggcccacacctgcttgagttccttcgcgttcgacgcgtcgatctgcttgagcggcgaatgcgactggccgtcgtaggtgcggtagtaggtcagccagcccggatcggtgtgcgcatcggtcagccgctggtaggtcacggccgggtagtccgcggccgcttcgacgaggccggggttcagcgcgacggccgctgccgccgcgatgccgatcgtcgccagccggctcgctgaagccgagagtttcttcatggttgtctcctgagtcattgtggtcgcaccgccgcgaacggttcgtcgcgccggcacggtggggattccgggccgagtgcgcagccgttcacgcaagtcgcatgccatcgcggcgcgaagccggtgtgacgcggcacacgggcgcatcgtgcgtcgtgcggcgtcggacgcgtcgggcacacgtgtcaacgaaggtgttgcattcaggtacaccccatgcgcgcagtgttgccaaacatgacaggtggcgcggcatccgtgacaggtggagcgccgcccgcgccggtgtcacgcaggccgtgcgcggcgacgcgcgcgggcgtcgtgccgacgcggctggcacggttctcgcacgctgcttcgcgacaacagcacgccgcgcggtgcggggcacaccacggcgaaatacaagcatggagacgaatgaaatgatcaggaggccaaaggcagccggaaagggcggcgcgatgcgacgcgcgcgtcgcgcgcggcacggtggcgtgatgcgtggcgcgcttctcgggccggccctcggcgccatcgcgctgttcggcctgtcgacggccagcgcgcgtgcgcagcagcctgcggacggcacggccgcgacgggcggcgccgtgccgccggccgccgtcgcggtcgcgccggaagtgccgcaagcgccggccgtcacattgccgacggtggtggtcgtcggcacgacgccgctgctcgggatcggtacgccgctgcagaaggtgccggcaaacgtgcagacggtacgcgcggcggaactcgatgcgcagcaccgcgcgacgcttgccgacttcttcgccgcgaacctgcagagcgtgacgatctcggaggcgcagggcaatccgtaccagacggacgtcaactatcgcggcttcaccgcatcgccgctgctcggtacgccgcaggggctgtcggtgttcgtcgacggcgtgcgcgtgaacgagccgttcggcgacgtcgtgaactgggacatcctgccgacgcaggcaatcgaccggatgcaattgataccgggctccaacccggtgtacggacgcaatacgctcggcggcgcactggcgatcacgacgaagaacggcaagtcgaacccgggcggcgaagcggaggtgtcgggcggctcgtggggccgcaagacggccgccatcgagcagggcggcacgatcggctcgaacctcgactactacgcgacggcgaacgtcgcgaacgacggcggctgggccgaccacaatgcgagccgcgtgcggcaggcgttcggcaagctgcgctacacggattcggacacgacgctgtcgatttccgccggcggcgccgacaacgcgctgtacggcacccagacgatcccgcgctcgttcctcgacaaccggaagcaggcgtacacctatcccgacctgaaccgcaacagcgccggctacctgacgctgtcgggcgatcgtttcttcggcgagcacgtcgagctgagcggcaatgcgtattatcggcacctgcgcaacaccaacatcagcagcaacaacaataccgattacggatcggtcggcgacgacggcacggtcgacacggtgcagggcaccaacgcgcagtcgacgatcgtgaccgacagctacggcggcagcctgcagctcacgctgctcggcaagctcggcgggatgtcgaaccagctgatcgcgggcgtggcggcggatgtcgcgaactcgagctacgtcgcatcgtcgcaggacgcgtatttcaccgacacgcgcgcggcgatcggcgtcggcgatttcgagccgcagacccgcgcgaagacgcgcaatgcgaacctcggcgtgtacctgagcgatgcactgtcgctgacgccgcactggacgctgacggtgtcgggccgctacgactggtcgaaggcgcagatcggcgacgagagcggcgcagccgctgctcgacggcaaccatacgttctcccggttcaacccggcgctcgggctcaactggaacccggtcgcgggcttcaccgtctatgcgacgtacaacgaagggatgcgctcgccgaccgcgatcgaactcgcatgcgcggacccggccgcgccgtgctcgctgccgaacgacttcatcgcggacccggcgctcaagccggtgatctcgaagacgttcgaagccggcatgcgcggccgcatcggcgcggcgacgacctggagtgccgccgcctaccgcacgacgctgaccgacgatatccagttcatcagcagcccggcaagcgcgcagggttatttccgcaacgtcggcgatacgcggcggcaaggcatcgaactcgcgggccgcacgcggttcggcccgctcggtgtcgggctttcgtacagctatgtcgatgcgacctaccggtcgtcgtggaccgagcacagcccggcgaattcggcggccgacgcgaacggcaacgtggccgtcaagccggggaccatatcccgggcattcccgcgcacacggtgaaactccggctcgattacgcggcgacgcccaggtgggatatcggcgcgaacgtcacgtggcgcagcggcgtgtatgcgcgcggcgacgagaacaaccaggacgtgaacggcaggatttcaggctacgtgctcgtcgatctcgacatgcgttaccggatcacgaagcgcttcgaagtcttcgcgagcgtgacgaacctgttcgacaagcgctatgcgagcttcggcgtgctgggccagaacttcttcaacgggccgaatcacacgttcgacggtgcgaatccggtcaacgaacagttcgtcgggccggcgcgccgcgcggtgcgtgggtcggcgtgcgctacgcgtgggattgagctttgcccggctgcgtgcgttgccgcgtcgcagcccgagcggcgctcaagatgtgcgcgacgggcccggtcgggcgagcggtgccgccgcgaacatcgcggccacggcgcgagcgatgctgcgtgccaatgccgggtcgcttgcgaggtgcccggcgctcacgtgttcgatcgcggccgcgggcacggcacgcgcgaggcgggtgacgttggcggccggacagacgggatcgtgcattccgtgcgcggcgaacagcggcacgccagcctgcgccgcccggcgcgcgagcgcgagcacgcggcgctcgccgagccagcagtcgtgtcgcaggtaatgcgcctggatccggtacttgtcgatcagccgggcgacggtcttgtgcgagcggatcgcatccgcgggtgagcggcgcgggttcggcgatgcgaggatggcgttctcgtacgcgtgccacgcaagcgccaccgctcgctgccgggccgcgcccgcgccgggttgcagccgccgcgcgcagcacgacagcaggcgatccggctggctgcagccggccgccgcgtacaggcgtcgccattcgcggggcgcgcgcgttcgcgatgtcgtgaacaaccggcggacttcgcgtcgcgacgtcaggaacagcccgcgcagcacgacgccggtgacccgtgcgggatgtgtgcccgcgtatgcaagtgcgagcgccgcgccccacgagccgccgacgacgccccagcgcgcgatgccgagctgcgcgcgcaccgcttcgagatcgtcgatcaaccgcgcggtgtcgttgtggcgtgtgccgccgcgcggtgccgacgcgcccgcgccgcgctggtcgacgagcacgacgcgcatccgcgtcaggtcgaacagccgcaggatgccggcctggctgccgctgcccggcccgccgtgcagcacgacgaccggatggccgtgcgccgcgccggcgacggagaacgcgatcgattgcgcgtcgcggtgcaagcgtccgcgaacgggcgcggcgagcgcggacggtgacgccggcgacgcgggtcgggatcgggatagggatagggatagggtgcgaatcggggcaggcatcgtgtcgaatcggttcggggaatcggcgcaatcgtcacgcggccgcacgggtgtccgggcgaccactgtatttgatccacgacaaagccagaaacgcgccagccgcaaagatcgggattcgcacgggtagtcacgcgtcgggcagacgcggtatcacgaagaccggcccgtccggtgacccgacctgcccggcggagccggatcgtgtcttgcaatctgctttcgattggggccgtgtgcctcgcgtggcccgatgcttgcttgcaatgacggcaaagagtccggcaactgaccggaagatccccggaggagacaatgcgcgatgacgtagagcaggcggccggatcgcgggccgcgcattccgccggctggcccgcgccgtcgatccagaaagcccatgagcggtccgagacgttcggcctgcaggtctcggcacgccccgactacgacgtgctgtcgagcgcggcgctggtgctcaagcgcgagcagagccgcgtgctgtgcgcgcatgcgatgccggtgatggagacgctgcacgagcagatcgtcaacacgcagagcatgatcgtgctgaccgatgcgcaggggttgatcctgcattcgatcggcgacgacgatttcctgcgccgcgcggagaaggtcgcgctgcgcccgggcgcgaactgggcggaggaccggcagggcaccaacgcgatcggtacggcgctcgccgagctgtgcccgatggtcgttcacggcgaccagcacttcctcgctgcgaaccgcttcctcacctgttcgagcgtgccgatcctcgatccgtacggcgacgcgatcggcgtgctcgacgtgaccggcgaccaccgcagctaccaccagcacacgatggcgctcgcgaagatgtcggtgcagatgatcgagaatcacctgtttacgacgacctttcaggagacgttgcaggtgtcgttccatggccgccccgagttcctcggcacgctgatggaggatcgtcgccttcaccgccgacggccgtttcctgtcggccaatcgcagtgcgcagttccagctcggcatgccgctcgccgcgctgcgtgcgcatacgctgtcgtcgctgttcgacgtcacgagcgcacagttgatcgaccgcatgcgcgcgagcaccgaccggcacctgatgctgaacctcggcaccggcgcggtggtctgcgcgcgcgtgcatttccggcgcgcgacgctcgccgaaggcagccggccgacggacgttcacgacgcgggtgcgccggccgcgcgcgcgaacgcggtgcccgcgccggcggccggcacgtcggccggcctgtcgcggctcaactacctcgacaccggcgatccgcaggttggatgcgtgatcgcgaaggtgcgcaaggtgatcggcaaggacatcccgatcctgatcaccggcgagaccggtaccggcaaggagctgctcgcgcaggcgatccacaacgactcgccgcggcgcgatgcgccgttcgtcgcggtcaactgcgcgtcgattccggagacgctgatcgaatccgagctgttcggctacgaagagggcgcattcaccggcgcgcgccgcaagggctcgatcggcaagctgttgcaggcgaacggcggcacgctgtttctcgacgagatcggcgacatgccgtatccgctgcaggtgcggctgcttcgcgtgctgcaggagcgcctcgtcaacccgctcggatcgacgaagacgatcgccgtggacatcgcgatcatctgcgcgacgcaccgcgatttgcgcgacatgattgcgcagaaccgctttcgcgaggatctgtactaccggctgaacggcctcgtggtgcgcctgccgccgctgcgcgaccgcacggatctcgcggtggtcgtgcagaagatgctgcaacgggaggcctacgcaggcccgggccggccgccgctgtccgtcgcgccggacgtgatggcgctgttcgtgcgctgcgcgtggcccggcaacttccgccagctcggcaacctgctgcgcacggcggcggcgatggtcgacgacgacggcgagatccggcgcgagcacctgccggacgatttcttcgacgacctgcgccgcgacgatacccgggccgagccggccgcgcacgatccgtccgccgccgcatggcccgcggacgcgctcccggcaggcgacgcgcggttgcaggatgtcgccgcgtccgcgattgcggctgcgctcgcgcgccacggcggcaacgtgtccgcggcggcgcgcgcgctcggcgtgtcgcgcaacacgatctaccggaagatgccggccgccgacccgcagcgccagccgtccgacgaaagctgacgcgcgccacgggttcgcggccgcgcggcctgtcacagccggtgtgtcaagttgcaacaccggtgttcaacgattcaacacctgtcaccgcccatgcgcatcgtgcggccgtggcgtcgaaccgcattcgcgccaatcgcgtaggcaaatcgtaaggattgcgtcccgatgcccgggcgagcgccgcgcatcgctgtcgggccgtcgaagtgcggcctcggcacgctccttgctgaataggaaccgaccgctcgattgccgcggttgtacgactcaccgactcaccgacgcaactcatcaactcaatcaggagacacatcatgcagtggaccaccccgtcttacaccgacctgcgtttcggcttcgaaatcacgatgtacatcgccaaccgctgatcgccgagcgtgccgcccgctttgccgtgatcggcgcgggcggcgtcgggagctgacgcccatgaagatcaagatactcggctcgggagccggcggcggcctgccgcaatggaactgcaattgcgcgaactgtcgccgcgcacgcagcggaagcggccacgtgctgcctcgcacacagtcgtcgatcgcggtcagcgacgacggcatcgactggatcctcgtcaacgcgtcgcccgacatcctttcccagttgcgcgcggatccggagttgcagccggcacgcgcgattcgcgacagcggcatcgccgccgtcgtgctgtgcgacgcgcagatcgatcacgtgacgggcctgctgatgctgcgcgagcgctcgacgccgctgccgctctacgcgagcgcgccggtgctcgacgacctgtcgaccggcttgccgctcgtgccgctgctcggccattactgcggcgtcgccgcgcatacgatcgtgctcggcgagccgttcacggtgccggcggcgagcggaatccgcttcaccgcgattcccgtcgacagcaaggcgccgccttattcgccgcggcgtgcgtcggccgcgcccggcgacaacatcgcgctgtcgatcgaagatgtcgcgagcggccggcgcgcgttctatgcgccggggctcgcggccgtcaccgacgacgtgcgcgcggcgatggacggcgccgatctcgtgctggtggacggcacgttctggagcggcaccgagatgatcgacctcggcctgtcgcgcaagcacgcggccgacatggggcatctcgcgcaatgcgcggagcacgggcggcccggcatgatcgactggctcgacacgctgcccgcgcgcacgcgcaaggtgctcacgcacatcaacaacacgaatccgattctcgatccgcattccgtcgagcacgcgcacctgcgcgcgcatggcatcgacgtcgcgcacgacggcatgcaattccaggtctgaccatgaacgcaccgattcccgctacggcattgcatccgacgccctggagcgcgaccgaattcgaggcgcgcctgcgcgcgctcgaatcgcgctatcacatccatcacccgttcaaccgccggctcaacagcggtgcctgttcgcccacgcagatccgcggctgggtcgcgaaccgcttctactaccagatcaacatcccgctcaaggatgcggcgatcctgtcgaactgccccgaccgcgacacgcggcgccgctggatccagcggctgatcgaccacgacgggcagggcgacaacgaaggcggcatcgaggcatgggtgcggctcggcgaggcgtgcggtctctcgcgtgccgaactgtggtcgctcgagcacgtgctgcccggcgtgcgtttcgcggtggacgcgtacgtgaatttcgcgcggcgcgcgccatggcaggaagccgtgtgctcgtcgctgaccgagatgttcgcgccgcagattcatctcgaccggctcgcgggctggccgtcgcattacccgtggatcgagccggacgggctgcattacttccgcagccgcgtgccgcttgcgcagcgcgacgtcgagcacgggcttgcggtcacgctgcagcacttcacgacgccggatgcgcagcagcgtgcgctcggcatcctgcaattcaagctcgacatcctgtggtcgatgctcgacgccgtcgaaaaggcctacccgcaatgaacgcgatcgaagctgccagcggcgtgccgctgcgcccctgcctcaggggcatgtaccgcctgcaatgggaggcggcccaggatgcatacgtgctcctctatccggaaggaatggtcaaactgaacccgagtgccggcgagatcctcgcgcgctgcgacggtacgcgcgagctggacgacatcatcggcgaactcgagcgcctgttcagccagtcggacctcgcgaccgacgtgtaccgtttcctcgatcatgcgcgactgcgcggctggctcgactgacatggcccccgacacttcccgtccgtccgcgccgctgtggctgctcgcggaactgacgtaccgttgcccgctgcactgcgcgttctgctacaacccggtcgatttcgcgacgcacggcgcggagctcgacaccgatgcgtggcgcacggtcatcagcgatgcgcgcgcgctcggcgccgcgcagatcggtttctcgggcggcgagccgctgcagcgcgacgacctcgagacgctcgtcgcgcatgcacgcgggctcggcttctatacgaacctgatcacgtcgggcgtcgggctgaacgtcacgcgcatcgagcggctcaaggcggccgggctcgaccatatccagttgtcgctgcaggattcgacgcgcgagctgaacgatttcctgacgagcacgcgcacgttcgagctgaagcgcggcgtcgcgcggctgatcaaggcgcatggctacccgatggtgctcaactgcgtgctgcatcgctacaacctgccgcacgtcggacagatcatcgagatggcgctcgaccttggcgccgattacctcgagctcgcgaacacgcagtactacggctgggcgatggtgaaccgcgaccaactgatgccgaccgtcgagcaggtgcgcgaggcggaggaaacggtcaaccgctatcgcaagctggtcggcgaacgctgcaagatcctgttcgtcgtgcccgactatttcgagcggcgcccgaaggcgtgcatgaacggctggggttcggtgtttctcggcgtcgcgccggacggcaccgcgctgccgtgccatgccgcgcggtcgctgccggggctcgcgctgccgaacgtgcgcgaccggtcgctgaaggaaatctggtacgacagcgacgcattcaacgcgtatcgcggcgaggactggatgcgcgagccgtgccgcacgtgcgacgaacggcatgtcgatcacggcggctgccggtgccaggcgtaccagttggccggcgacccggcgcagcccgatccggtgtgcgagaagtccgcgcatcacggccgggtcgagcaggccgtgcaattcgcgcggcgacccgcgccgcgcgacgaacagccgctggtgttccgcagcaaggagaattcgctcgcgcaatgtggggcggcctgcgactgctgacaaggcacggcggcggcggggtgaacagggcaaggcaacgcgatggaagccggatcgatagatatgcattcctcttcatgtcggcgatgtggcgcgcgtgtacgaggatgggtgagcgcgggaaggcgggtgcgatgagcaccgctgccttcggaacacggcaggcgaccgacgtgcgtggtgccgctggcgatcgggtacgccgtcgcggaacttgcgtcgcgtcggtcttcgctgccgtatgcgctctgcatgccgccctgttcgttctgctcgcacacgagcagatcgtacgacgcgaaccactgcaacggcaggtgatggtggcgacgctgatcgcggcggtgccggaggcgtcgacgatggcggccgcgaaggcgaagccggttgccgcgtcgcgcgcggtgcaggaggctacgtccgcgccccgatcatctgcgggcagtgcgttgaggacgaaccggcaggttgcgtccggccgtccccgcccgccggcgcatgacgcgcctgtgccggctccggcacagtcaggtccgtccttgccggccgcggcgcaacgcgatacgccgcacgacgatgcggccgcacgaatgccgacgcaggcgcagactcaacccgaatcccgatcgtcttccgtgtcggcgccgccgcgcttcgttgcgcatcccgactgcgcgctggtcaaacccgactacccgccgcagtcgctgcggctgggcgagcacggcaccgtgctcgtcgaactggagaccgatgcggcggggcagatcgtcgccgcacgtgtcgtgaccggcagcggttatccgcgtctcgacgcggcggcgcgtgaagccgtactggcgagccgctgcgcgccgcatgtgttcgacggcgcgccggtgccgacgcgggcacgcgcgccgatcgcgttcaatctcgacgactgacaggacacttcatcatgacaatctacggaatcgagcacgtatggacgcagggcgacccgatgacgcgcgcggtcgcgctgttgctcgtcgcgatgtcgatcgcatcgtggacggtgatcgtgatcaaggcgatcgaactcgtcggcatccggcgccgcgcggcgcgcgcggaagcgcgctttcgggacgacggcggcgcggccggcgcgatgcacgcgctcgggggccaggacaggccgttcgtcgatctcgttcgcgcgggccaggcggcgatcgcgcatcacgaagcgagcaggcaccggctgcacgaccggatcgacgcgagcgactggctgtcgcgcagcctgaagacgtcggtggacgaatccgcggcgcggatgcagcgcgggctcggcgtgctcgcatcgattggcagcaccgcaccgttcgtcggactgctgggcaccgtctggggatctatcacgcgctgctgtcgctcggcgcaaccggcgaggcgagcctcgaccgggtagcggggccggtcggcgaggcgctggtgatgacggcattcggactgtgtgtcgccatccccgccgtgctcggctacaacacgctggtgcggctgtcgcgcgatatcgttgcacggctcaaccgcttcgcgcacgggctgcatctgttgctgctgaccggcagcgtgcccgagcccgccgggcgccctgaaccggcgatcaggatgccggccgacctgcaacctgccgccgacggagcgcgagcatgaacgccggcccggacgacgcgcccgaagggaatgcacttgcagccgagatcaacatgaccccgctgatcgacgtgatgctcgtgctgctggtggtgttcatggtgacgctgccggtgctgcatcacgccgcgcgcgttgcattgccgcaggcggcgagcccgcgcgaggatacgagcgtgccgcatgtggatgtctcgatcgatgcgggcggcggcgtgagctggaacgcgcagccggtgtccgataccgggctggcggcgcgtctcgcggcggcggcccgcaccgcgcctcagccggaagtgcgcctgtctgccgatcgcgcggcccgctacgacagcgtcgcaaaactgcttgcggccgcacaggcggccggtctcacgaaagtcggcttcgttaccgcgcccgctcgcggccgatagctcgcgcggtgtcgcgttgcatgggcgatgcggtgcggcaccttcgccgcacggcatcgcgccggggcttacttcgccgaactcgcgctgaccttcgcgaagtccaggctgccgaagcccgtatcgtcgtcccagccggccttcgcggtatagccatggctgctataaccgttgttgcccgaggtcacgtcgtggagcagcgacgtattggtcgggaagttctggtagaacgccgacgtcggcaggccgaggctgttgttgttcgccgattcgacccgcgcccagccgccgacgaagatcggcgaagcgaggctcgtgccgccgacgagctggttggtctgcccgttgatgacgatgtacgcgcccgtcgattgcgcggcgtcgaacgccacgtcgggcaccacgcgtttcgtcaccgtgctgccgagcgcggccgtctgccagctcggcgcggtttcgaacgcgctcacgccgccgcctgtggcccagatccgcacggcgttgtcgaccgggttgccgttgctgtcgagatccgcgtacgcgacgccttcgttccacacggtttcgcctgcccacgtcgtggtgccggtggtcgagagcgtcgtgccgccgaccgcgacgacatacggcgaactcgcgggcgacgacacgctgtacttggacaggttgatcgtcgtcctgaccgacgtgccgttgtacgtgccgatgtagccgggcgccttgcggcgacgtcgaccattgatagacgcccgcgtcgccggccgagaccgagaagacctggccctgcgcgacggcctgcttgaacaccgcgtcgtcggcggcgagcgagccgtccgagttcgcggcggtttcgtcgaggccgagcgacacgttgatgacggtcgccttgttgtcggtcacggccttgttgtacgccgcggtcagcgtcgcgtcggtgaggccgctgtcgttgctgtcgccgttcaccgccgagtagaagatcagctgcttgacgccgccggacgtgccgatgatgtcctggctgtcgagatcccattcgcccggatcgccgtcgtcggccagcgtgcccgatccgcccgcgaccacggccgtgttgacggtcggcaggccggcattccgcgtgaaggtgttcaggtcggcgatggtctgggtcatgtcgccccaggtgatgatgcccaccgtggtgttggtcgcggcgggcaggccgctcgcatcgtagatcttcgcgaaatcggtcggctggtggccgacctgttgcgacgcggcggccgcgttcttcgcgatcttgttcggctcgatggcggcggccggcgcgaagcggtggagcaggcggtgcggtaccgcggcgttctgcaggccgagcaccgcatcgacgaccgggccgagcgacgccgggatcaacgcggccgaatcgttcgcgaagaccggcttgccgcgatagttgaagcgcttgatgctcgcgtggaagccgttttgtgcgttggtcgcgttgccgtcggcggagaccagcgtgttgttctccgacaccgtgacgttgctgaagccgtttgccttcaggtgggccacgacggccgcgacctggtcgtcggtcggcgcgaagcgcgccttgaactgcgcgggcgtcaggtacttgcggtagttcgcgctgcccggctggttgacgtcgcgcaggaacgcgtcgagctggtcggtgttgcggttcttcagcaccacggtgacatgcagcggctggctcagttcgagcggggtgacgtgcgtgtcggtgagcgccggcgtgccgatgctgttgagcgagtacgcaggctgggcctgcgaggcggccgaagcagccgcggcgggcgcattcgacagcaggaaagcggcggtgcgggtcggcacccagctggttgcggcctgggcgggcagcggcgccagcgtggcggctaccgcgagcggcagtgcggcgagggcaaagcgttgcgagagtgtgcgattgacgtgctgagttctctgcattgtgagctccgagatttcgacgaagaaccggtgcagcgcgcgacccggatcgcgggtagcggcagggcggcgcatgcaacctgacgcaagaccggaccgaccggcgtgattcacggcgacataagttttcctcccctcccaccatcaagatcggaggccggcccgggtgccggattcgcgtatcgcgaacgtcgatccgcgcacggcccgctatcgtgccggctcgcgtcgcagcaacggcgcgcgtgccggccatctgtttcccttcaatctgctgttgcggatgtttcgttgcgttatcacttaattaggaatccaatgaatgaaatccatataagcgagaaatgcatggtcgagcgacgacgtggtgtgcgtgtttcgtgtgaggtgctgcgggcgagatcgaatgtcccggtcaaccgggagagatgtcgacatcgtcctcttccgccagaagcggaacgggatgaccggtgaagcgggagctgtgtgttgcgagcgggtgccgcggcttacgaatcagctacttctcgttttaaacgtaataaaaacggaagttgattgtcgggccattgatttcctgatgcggattcgatttcccggcgatattgcttgcggggaaagatagcaagaaagaaaacgacgagtcaaacttttttgattaggtttaaaaagtttagataatcgcttctcagggtgtttttataaacggaaaacgattatgtaagtcattcgtcatcctcgacgagtgagatattgacgcaatgcaggcgcagcgcaggcgttgccgagaaccggtgcggccgctgtcatttcgcggtggtgttctgaaaccggctctcgaggtttccttgtcggtgtgtggcgggagagcacttgtccggcgcagcgctcgattcccttcgattgaagccgggcggatcgcacgccgggtgttgcacggcatcttcttttccttcttgccggctttcccgattcccgcagcggcggcgcgcaggtcgcgcgccatgtgccgtgcatcacggcccggcgatcatccgtcgtccgccttggcctgcaatcccttcaacccctggatcacgaccagcagcgcgcggccgtgctcgtccgatccgtcccacgcgtcgacgatcgcgtcgcgcaacaggtcgttgtattggcggcgcgatggctcggtatcgacgccgtagaaattgcatagcttattgaatggcgcgctgcggcgcagccgatgcccgttcgacagcctcaggcgcgatacggtcggctggctgaccccggagagtcgcgctatttcgctggacgagcgtgtatctgccagcaggcggcgcaacaggtcttgtacgggaaaatcttggtccggggcttccatgcgatgcattatacctatacagttacggctgttgaatgggcttgctgtcaccagcgaggctgtatcccgagaaagttgatgacactgaaacacctcccacccacgttctgctggaccaagatcggtaccgagtccggcgaggaactgccgaccgtcgtgctccgcaaggaatgggagcgccggctcggggcgggcgttttctgtggggcatcaaccagccgctcggcaacagcgcgcagatcgccgcgcaccgcacgggctcgctgctcgcgctgttctcgccggtcgcgtcgcgcccgcgcccgggcgaacgcaaggacgcgctgttgtggaatgcctggatcgacgcgagcgggcaggtgcggccgttgccgccgcataccttcatcgcgagccgctcgaccttgccgtcgggccggcgccgcgaacagcactacgcgctcgtctgcgcgtcctccaccgcgctgacggtcggcacgcaattgcgcgtgtttcccgatcatctgcgcagcgtgagcaccggcaaggcgctcggcgccgcgcagggcgcggccgtggtcgattgcgtcgggcgagcgaaggagcagacgggcaagagctatccgctcgcgctgtcggtcgaactcgaggcaccgtatttcgtgcggctcgcccagccgtgcgtgctgaaggcgcgcgatctcgcggaagtgaacaaggcgacgcgcgccggtgatttcgatcgcttcgtcgaactcgtcgcgcgcttgcgcggccgttcgccgacggacgccgtgcgcggcgtcacgcgcgatctgttcgacgtgccgccgatcgaaacggcggccgcgtatgtggcgcccacgcacgtggcgcgcttgcgcaaccggccggcggccgagcatccgcgcgatctcacgggcgacctgttcgacctgtcgccgggcgaggcggccgcgttcgcgggccttgcacatccgcgcatcgggcgcgcgtgacgaatcgcgcgcggcacgtcgcgcaagaatttgttgcaatctcgccatagcggagcggcgagtgcagaggacaatcggctcgaagcgcgttgcgcggcggccgatgcgtcgacgatcgacggttcgtggttcacgctgccgacatgcgcaccacgaacacggggcgtcggcgtgcttcacactgcaaccctgagggagaagtgtcgatgtcgacccacatctgttcgcgggaagcccgggccgcgcaacgcttcgtcgaagcaacgcgcaacgtcgatcaggcctttcgcgccgtgcgcggcgaaagcgacgacgacggttcgtcggccgaatacgcgcgcgcgatgtcgcgcctcgatcgcgcgctcgccgagctggcgcgtgcgcaggagttcttcgatcgcgtggtcggcgccgataccactgcgcacgacagctgattccgccgcttccacgtgtccgcgcgtcgagtgacgtgcatgcctcttcatgccgggcagggtagcccggcatctcattcgtcccgttcagacttcagaccttgcggccttcgaccggatagccgggctcggtatacccgtgcgtcgatgtgtgcccgagcggcacgagcgaatcggcgaaccgctcgtcgtccgggccgagttcgagcgtcagcgtatcgatgtccctgtcccgatgcgcttcggtgcgcggccgcgcgatcgtcgagccgacgatgcggttcttcatgacccgcacgagcgcgaacgccaccgatgtcgtgccgcgcggcggcgcggcatacgcgtcagcccgcgcgtgtcatctccggcacagccggtgcgggatggtacgcgtagccgcgatgctggaacgaggtcgcgaagaaccgcatctggtagcggatcgcattcgcccagtaatcccacgtatgaccgccgggccgctccgtgtagtcgtgcggcacgccgagcgcgagaaggcgttcgtgcagcgtgcggttcgagccgacgaaggaatcgtcgcggccgcaatcgatcgccaggtcgagatgggcgcgcacgaacgcgcgcgcgctttcgacgatcacgttgcggttccagaatgacgaatggcgttcgggatcgccgaacacgtggtcgatgcccggctcgtccgcgcagcagcgcggatcgaccgcgccgctgatgctgccgaccgcgccgaacgtgtcgggccggtcgagtgcgatgcgcagtgcgccgaagccgcccatgctgagcccggtgatcgcgcgtgcgtgctgcgtcgcgatcgtacggaaatgcaggtcgacgtaggacacgacttcatcgccgatgaaggtttcgtagcggctgcccgaatcgaacgggctgtcgatgtaccagctttcgtgcccgccgtcgggcatcacgaggatcacgtgatagcggtcggcgagcgcggcgatgtgcgtgttcgacgtccagtcggtatggtcgccgcccgagccgtgcagcagatagacgaccggatagcgctcgttgccgcggttgtcgcgcgcgtaatcgtcgggcagcacgatcgtcgccttcagcgtctcgctcatcgcggcgcttgggatcgcgacgacccgcgcatgaaacgcgaaggcagggctcgtgacggccagcagcagaagcagccagaaggtacgtgccaggtgcatcgatcgttgcatgtgtcgacccagtccggcgccggacgccgggaaaaccctgttccggtgactctagcaaccgcgcctttcaaccaaatttcggcgaatcatacggtttcgacatcttcccggcctgacgaccggagatgcctgctgcgcccaggatgcgcccgattgcatcgcgaaacgcatccggccgctcggccggaatcaagtgcccgcagcctgcgatcgtgtcgaagccggcgcagcgcgcgagcgcccagtcgggcacgtgccagcccgcgcgtgagcgttcgccggcgacgagccggacgggatgacgctcgaacacttgcgcgagcgcctgcaggtagccgggttcgcctgtcgtcgcgacgacggagcggcccatcgcgcgcagcgtcgatgcaggttgatgcgcgagccagcggcgggcgtcgtcgagctggcccggcgacggcgcgtcgatcgcgccgcgcagccagccgagcggatcggcgcgcagcccgtcgagcatcgcgtcggcctcgccgggcgtcatgcggccgaccgacgccgaccagaacgcatcgtcgagcgtgaagttgccttcgacgttgacgatccgccgcacgcattccgggtgcgcatgcgcgaacagcatcgcgatcgcgccgccgaccgagtggccgacgacatcgaccggttgcgcgccgaagtgagcatcgacggtctggcgcacatgctcgacctgagcggtgagcgaaatcgcgtcgaatggcaccgcgcgatatgcgccgtagccgagcaggtcgggcgcgagatgcgggccgttccatccgcgcacgtcgagcgtgccgatgaaaccgtgaatgaagacgacgggcgtgggctgggtcatggggcgggcgggcaaggaaggggcggcaatgcgagttcggcgagcagttcgtcgagttcgagcacgtgcgtgcggtcgtggtcgagcagttcgcgcacgagctcgtcgagcgacatgcggcggatgccgtcgcgcagcccgcagcgtgcgagctgcgcgggatcgagcgcggcggcggcggtgcacgcgccgcgcggcccgtgcggaaaaccgcgaccgccgcgtcgagcggctgcgcgagatagtcgcgttgcgcggcgagtgcggtgccgtcgacggaggcgatcaccggcaggtcgagggtgcgtacggcgtcgatgcgttcggcgaataccgcgtcgagatcccgcaggtggcacgcatgctcgacgagcgagaagcccgtgccgtcggggcggcgcgtccgcagtgcggccggcacgtgcgccgcatacgcggcgagccgatcgggcagttgcgccagcgcggcgacgacaccagcgaacggcaacaactgcggatgcgcgctgaacaccgcgccgtaactgaacagcgtgccgccgagccgcccgcgcgcctgcacgacgtcgtggccgtggcggcgcatgacgtccgcgaccatcgcgccgcagaactggcgggccgtcgtgtcggtttcgatttcgggaatttcagcgcgatctcgtgctggatcgcgccgatcgcggcgacgcccacgcgtgacagtgccgcgaattcgacgtagcgctcgggttgagcgatcagtgcttcgagctgggcgccgagcgcggtggtgcggaagcggtcgaaacgggaatgcatgaaggaaagaaccggcctagtaacgtctcaaaacgatacgttactaggccggtagcgtcaacggcgggatgagcgcgatgcgctgcagcaagcgttgccggcgcccggcggtcatgcaagaccgcctgacgccgcccggcttacgcgtgtttcccgcctcggcttgcgcactctgctgcgctttcagttcctgcaactcggccgtgaatgccgggctgaaatcctcggcctcgaacagcgggcggatctcgatgtcggagtcgccgggcatcgggttcgggcagcgcttcacccattcgaccgcttcttccatcgatttcacctgccacagccagaagccggcgacgagttccttcgtttccgcgaacgggccgtcgatgacggtgcggttcctgccggcaaagtgcacgcgcttgccgcgcatgctcgggtgcagcccgtcggcggcgagcaggatgccggcttgcgccagttcttcgttgaaccggcccatcgcggcgatcatttcggggtcgggcatccggccggattcggaatcggcggtggccttgacgattaccaggacgcgcatggtcgtatctccttgaaaggaatcagggcgccgccggccgcgccgacggcaaaaacgatcggttacgacaacacgacgcgcgacggcgacgcgaatcgacatctggcccgacgaatattcggggacgcacgcaccggcgggcgatgcggcggagccctttgccaaaactgttatgctggtcctcaccacgttcacgcggagggtgccatggctgctaaggaagtgtcgaagaagaagtacctgaaaatcctgaacaaacgcctgcgcgcggaaccggcggccccggccggcgcgtcgtttgtctttttccgctgggcgcgaaggcgaagaacgcgacgggtgtcgtgtccggcgatgcgcgcagcaagcgcgaactggcggtgatggccgcggttcagcgcaaggcggccgaagagttcgtcgtcgccggcgcctgaccggaacaacctgccggaccgtcgtccgggttgccgccaccgcggcttacgcggcggcggcctcgcaatgcgcgattgcgccggcgagcacgcgcgggatgtcgtgtgtgatggccgggccgtgcatcggcaggatgacgtcgagatcgagcgcctggatccggcgcagcgcgctcgccaagtgtgcgagcgacggcaggtagtccgagcgccggatcgaatcgaggatggccggcagcgggtcgtcggcggcttcgtcgccgaagcgcatcaggatgtccgacgacagcagcgccttgtacgccggcagatacacgacgagcgcatcccattggtggacatgcttcgtgaagatcggcacgacgtcgacgccggagatcgtcgtcggctcgccgtccttcagcggcgtcgcacgcacgccgaagatatcggccagcccgtgcgcgcagatcggatgcgcgtatgcgacgagcgccggattggccgcgaggaagtcgggcagtgcgcccatctcgtcgacttcgaaatgcgggacgaccacgctgctcaccatcgacggcgcgatgccgacggtcgcgaggctcgcgctcagttgcggaaagttggaacgcgtgcccgtttcgatgcagacgacgtcgccgtcgggcgaccggatgaagaactggctgaagccgagcttcagcttgtcgatgtaggtcgttgcgcgaaacaggccgctgcggatttcttcgatacgggcggtgtccatcgaggcggtccttgcgcgggcagtggggcggggcacgccgatcgcgcgcgccgcgatgcaccaagggcgcgcgacgcggtgcctcgacgcagtctagcagcgccgcgccaggcgcgaatcctgtcagttcacgcagcagccggcacggcgctgaacgccatgccggccggaaagcatgcccgggtcgtcgatgcggcgctcaggacatcttgtcggccgctgccgcataccggccgccgccgcccgcttcgtcgcctgccgcgagctgttccagcgcgagcccttcgtctcgatgccgagcgtccacaccgcaatggccgccgcgacgaacgacagcgcgccgagcgtgaacacgccgccctggccgaacaccggcagcacgacgccgaccacgtaaggcccgatcagcgagccgacgcgcccgatcgccgatgcgaagcccgaccccgtggcgcgcgcacccgtgccgtacagttcgggcgtgtacgtgtacagcgcggcccacatcccgaacaggaagaactgcattgcgaggccggtgacgatcagcagcgtcgtgctgccgccgtacagcgcgctctggccgtatgcgtatgccatcgcaccgccgccgatcagcgacgcgatgcaggtcggcttgcgcccccagcgttcgacgagccacgcggcgcacaggaagcccggcacgccgccgagcgagatcagcaccgtgtagaacaccgatttcgtgacctcgaagccggcctgctgcagcagcgcgccgagccacgacgtgaggccgtagaagccgagcagcgcgaagaaccacagcagccacaccatcaccgtgcggcgacgatacacgccgctccagatctcgcgcagcgcgccgtggccgcgtgccacgaccggttccgcaagccgcgacggcggcggcagcgtcgtgacgccggccgagcgcatcaccttcgcctcgatcgtgtgcatcaccgtgtcggcttccgcgtgccggcccgcatgctcgagccagcgcggcgattcgggcacgatccggcgcacgacgagcacgaacacggcgggaatcgcgagcagcgcgaacaccgtgcgccagccgaactgcggcagcacgaaatacgcgacgatgccggccgtgatgaagccgagcggccagaagccgtccatcagcgcgatcaggcggccgcgcttctcggtcggcacgaattcggacagcaatgtttgcgcgaccgggaattccatccccatcccgatcccgagcagcacgcggtagacgatcagcgcgtcgacgctctgcgcggtcgagcacaggtaggaggccgcgccccacagcaccatgctccactggaataccggccggcggccgaagcggtcggcgagcaggccggcgacggccgcgccgagcaccatcccgaagaagctcgcgctcgcgacgaggccggcggccgcggtcgacaggccgaactccttgcggatcgagccgagcacgaacgtcatcgtgccgaggtcgaccgagtcgaagaagaacgcgatcgcgatgatgaagaagatccgcttgtgatagccggagaacggcaggcgttcgagccgggcggcggcggaggcgggagcggtggcggcgggcatggcgtcctctgaaatgaaaaggggccgcgaagcgcgtgcttcgcggccccgatgcttcgtcttcagtagacgcgaccacaaaatgccgcatcagaggaaaagcgccgcctgcttgcccaaatgcgtcatcggcggcggcacatgccgtatcagttcttcagcttgtagccggtgcggaacatccacgcgacgatcgccagcaggatcacgaggaacagcccggtcgcggcgaggctgatccacacgtgcacgtcggcgagcccgtagaacgaccagcggaagccgctgaccaggtagacgatcgggttgaacagcgtgatgacgcgccacgcgggcggcagcatgtcgactgagtagaagctgccgccgaggaacgtgagcggcgtaatgatcaggagcggcacgagctgcagcttctcgaagctgtcggcccagatgccgatcacgaagccgaacaggctgaacgtgaccgccgtcagcatgaggaacagcaccatccagaacggatgcaggatgtgcagcggcacgaacaggccggccgtggcgaggatgatcacgccgagcaggatcgacttcgacgcggccgcgcccacgtacgcgatcacgatctcccagtacgacacgggcgcggagaggatctcgtagatcgtgcccgtgaagcgcgggaagtagatgccgaacgacgcgttcgagatgctctgcgacagcagcgacagcatcacgagccccggcacgatgaacgagccgtagccgatgccgttcacgtcgctgatgcgcgagccgatcgcggagccgaacacgacgaaatacagcgacgtcgagatcaccggcgcgatgatgctctgcatcagcgtgcggcgcgtgcgggccatttcggcgcggtagatcgcgcggattccatgcaggttcatgcgtcaggctccttgctgcatgccgttgcggcggttgtcgatcaggctgacgaaaatgtcctcgagcgaactctgcgtcgtatgcaggtcgcgaaagccgatgccggccgagccgagcgcgttgatcagcgtcgcaatactcgcatcgtcgcgctgcgagtcgtacgtgtagacgagcgctgcgccgtcgtccgcgcgttcgaggccgaacggcgcgagcgcgggcggcacgtccgcgagcgggtgctcgagctgcacggtgagctgtttcttgccgagcttgcgcatcagctcgcgcttctcctcgacgagcacgagctcgccgccgaggatgatgccgatccggtcggccatttcctcggcttcctcgatgtagtgcgtggtcagcaggatcgtcacgccgctttcgcgcagcgaatcgacgagcttccacatgtcgcggcgcagctcgacgtcgacgccggccgtcggctcgtcgaggaacaggatgcgcggctcgtgcgacagcgccttcgcgatcatcacgcggcgcttcatgccgcccgacagcgtcatcagcttgttgtcgcgcttgtcccacagcgacagcgccctcagcgtcttctcgatatgtgcgggatcgggcgccttgccgaacaggccgcggctgaacgacacggtcgcccagacggtttcgaacgcgtcggtcgtcagctcctgcggcacgaggccgatcatttcgcgggccgcgcggtagtgatcgcggatgtcgtggccgccgaccgtcacgcggcctgaggtcggcgtgacgatgccgcagatcgagccgatcagcgtcgtcttgccggcgccgttcggcccgagcaacgcgaagatctcgccggggcggatgtcgagggtcacgtgcttcagcgcctggaagccggacgcgtaagtcttggagaggtcggagacggaaaggatcggttgcatgctcacggatggcacggccggccggcgcaacggtgtgcgccgcgcgtgcccggcgccgccgccgctgcgaagcggccgggaccggggacggcatggcgaacgggcgtcatgtcgaacggcgttgtggtgcgggatcgcaggatcgcgggatcgccatattagcaatcgacagatggaaatgcattctcgtggaaagggcgagcattgccggtgctggattggcgcgaattgacagcgcatcgcccaataacgcggtgttttatttgcggtgtttgaacaatgcgtgccgttttatgcgaacggggatgcgatcgcgtgtccgtccggcggcggcgcggccgtccggccgactgtgccgcccgaaggccgtcgcgccgtaccgggacggcgcgcgccgcgctcgcgataatgcgttcctttcatcgtttacggagcggaacgcatgtctttgatcgatttcaaatccgtggcggccgcgcaggccgtcgcgtggaaatccacgatcgttggcgaggtcgggccggccaggatcaaggtgctgcgcatggatgcgcaggcttacgaagcggaagtgcacgactacaacgaggggttgctggtgctcgacggccggatgatgctcgaggtcgggggcgagacggtcgtcgtcgaggccgggcaaatgtacctggcgcttgccggcacgcctcacgcggtgctgccgggcagccacggcacgctcgcgatcgtcgacgtataaggttgcgctgcagcatgcaggcggatcgtcgagggccgacaggcaaggcagagcgcggatcggccgtggttattcaaacgcgtgttatacgggtcatgtatttgtctgagcaaataaattgaaggctgtttgaaaatctgtcaaatccccggcacgcactgcgattgcgcggtttcggccgtttggaactctgcatccatttacttgtaggaatcgtccgatcatagtctcgtcaaacgacgcatcacgataacgaatcaagcgtacggatggagaccaattgatgagacgcctatccgcggggccagtcggactgccgtttcccgctttttcgctgaacgcaggcgcgatgcaggtcgcgtacctgcgttgtcatatcgccgtgtagcggcgaaccacatcccgtttcgattgttctcacggcgccgtgccgcatgacggcgccgcgggagagcgcttgtctgccgccgcggcgcgtgccgcatttgcctgaccggcatcgcggcagccttgcgcacaccgtcatgcgccgcgcgttcgtgcggcggcgcgataccaaccggcgggccatgcagcctgtccggacgagacttgtcgtacctgaaaaggaggggttgatgatttgcattcctgaatggcggaaagcgatcctgtcgtgcgcggtcatcgctttgccgttcgtcgccggttgcggcggcggtgacgatccggggccgatcaacgtgccgcagtgctcggggagcgcgtgcgggccgagcggttccgtcacgacgccgcccgtcgtcacgaagctgtgcccggacgcgctcgactacacgacgacgtacacgggtggcgcaggcagcggcgagtacgtgaaggtgaagttcgacacgacgaagatgacctaccagatgcagttcatcgaatcgtcggtgccgacgtcggcggggcaggtcaacaatacgcgcgcaggcctgacgatcagcggcgcgttccatcatccgaccacgctcccgaccgccgagcagaaccgctgtgcgttcgtgctcgacagcggcgcgacgagcgacggcgcgtattcggtgacgatcaaccgtgcggatccgccgatgctgttcgtcggcaatggcgtggtgggcggcgggattccggggcgacgattgcgttcgccggtatcccgctgctcccgggcatcacgctcggcgtcgtaccgtcgcgcaccttcgatttctatccgttcatcggcttcaccgacaccgaaaccgacttcacgaaagtggcgggcaactacaacgaggtcggcatccatctgtcgccgatcggcggtgatggtcagagcccgaccgggccggtcggctgggagcccgacgtcgtcaactggaatcagacgttcaatgcggacggttcgtgttctatcacgcagggcagcgactactcgtgtcagacgaccgggacgccgtgggcgcagcgcaagaacgcggacggatcggcagacaatgtattcgtgagcaatccggtggggcaggggtatccgatcgcggggcagggctcgacgctgatcattgcaccgagtcaggcgaaaggcatcatgatcgtcggcaggctgaacggcgtacttgtgccgatcgtgattcgtgtcggctatacgcacgtcgatacggtcaatctgttcgcatcggtcgccgatgccgaagtcggcatctcgatgctggcgtcgacgaaagcgattgccgcgaactccctgaagggggatatatcggtgcgaccagcgcatccgcatgcggcgttgtgacatccagcggtcaggcgaacaaggtgacgtcgccggggccgagcttcaacccgaacatgccgcacccagacctgcccggcgtcttcaccaataacaccttctattcggtagcaggcagttgcgatgacggcacggccgtctcgacgatggccgcgaactatacgtccacgctgttccagggcagtaccgcggcgttcatcgatccgcagacgtcgggggtgacctcgcagttcgggctcgactacacgcaggcgacgcccggcaagatcaaggtcacggccacgcaggacttcaacgcgaagggcgcgagcggcaacgtggcgatcttcaagaagggcgacacgggctggctcgtgacggccggcaatgtctacgcgatggtcgtcaacaacagccaggtcaacccgttcttcacggtcggcgcgttcgtccagtaaccctgtattgaacacgtaacaccggcggcgcatgcgtcgccgccggcgaatcgaatttcaagaggattcctatgaatttgaagcaatggatggccgcggcatcgctcgcgcccgtgctggctgcgtgcggcggagacggcgacccgccgcccgcgccggtggtccggctgtgcccgcagacgatcgactacaacacggtgttcatcggcggctcgggatcgggtgagctggtgaaagtgcagctcgacacgacgaagatgacgtaccggatgacctacctcgcatcgccggtgccggccacgacgggcaccgtgcagccgacgcgcgatacggcgcccgccaatgtggtcgacggcacgctggccgacgaaacgggcctgccgacggtcaagctgaaccagtgcacgttccggatgcagaacgcgagcctcgacccgagccgccccgcgcggctgttcctcggcgaaggcgtgctgggcggcgcgatccccggcgcgacgatccagttcgacggcgtgatcggcgtcggcaagatcccgaagacgacgttcccgtactacccgttcatcagcttctcgtcgctggaaaccgacctgacgaagatcgccggcaagtacaaccagctcggctaccaccaggtgccgtcgcaaagcttccagccggtggcgctcgaccagcaggtgacgatcaacgcggacggcagctacgtcgagaccgacaacttcggcaagaagaacggcgggcagccgctcgcgtcgagcgcgaccgtgaaccagccgttcacgctgcgtccggatgcgccggcgttccagtcgctcaactacctgccgcagattccgccgacgctcgcggcggtcgatcccgcgaaggccggcaaggggatcctgatcgtcggcaagctgcgcaaccagctcgtgccgatcttcatccgcaccggcgcggcgaatgcggacctgacgcagggctcgccgagcgcggacgacgaatcgggcatctcgttcctgagcccgcagacggcgatcacgcaaggctcacagaacggcgagtacacgggtgtcgacagcgcgttcaactaccgcgcgaccgcgctcgtcggcgcgcaggccacgctgctcgatccgttcaacgcgtcgcaggccgcgctcacgcgtgcactgaacctcgatttcacgcagaaggtgccgggtgtcgtcacgaccgtgcatgcggatgcggcatcggggccggcgaccggcaagttcgtgttcaccggcggcgtgttcgggttcctcgacatgaacgatacgagcaatccgtacttcacggtcggcgccttcgtgcagtgacgcaagcccggatggagacacggcggcgccgcgcgaagggcgcggcgcccggacagaacgagaaggagacttcatgaagaagctgattgtcgcgggtgtcgtcgcaggcatatcgacgctcgcatcggcccagcaggcgggcgacaacgtcgcgacgctgggctggttgcacatcatgccgcaggattcgaccaacgggctcacgacgaatctcgccggcatgccgatcaacgggccgctgcgcctgcccgggtcgttcacgtcgcccggcacgagcctgactgtcaacaacgccgatacggtcggcctgacgctcacgcacttcttcaccgaccacatcgccgtgacgtcggtgctcggcgtgccgcccgagttcacgctgaccgggcacggcacgatcaagccgccgggcccgtccggcgcgctgggcagcgtcaacatggacaacccggccaaccagccggccgtgaagaacgcaaggcagtggagcccgacgatcattctgcagtactacttcaattcgccgacggcgaagttccgcccgttcgtcgggatcggcgtggcctacagctggttcagcaacatcgaactgaacggcaacttcgcgaaggacatcaacgaaaacctcggcagcgtgctcgcggcgggcgccggcaagccagggccgacgtcggtcgagggcaaggcgtcgtcgtcgttcacgccggtctacaacgtgggcgcgagctacgcgatcgacaagcactgggggctgacggcgacgctgacgtacatgccgctgaagacctactcgtcgctcgtgatcaaggcggcggacggttcgacgctcgcgaccacgcgcacacggttgaaggcggatccgctgatcacgttcgtcgggatttcctacaagttctgagccgtccggcgcgcatgacgcgcaccggcggctttctgcgaccgtcgggccggaacgatccggccgggcggtcgcgttcctggcggcgtgccgccatttgtgaagagaggggcagttcaaatgagcattcgcaaaatcgtatcgcttgttgctgcagtggctttcaccgcggtttcggccgcgcctgctttcgcagtgaccgtttcgcgggctgatggtcagccgatgaacccgaatggcgagccgttctcggcgaccgggctcacgaacctcagcaagggcgcgatcagcgcaggctgtaccgcgacgttcaacggcacgatcacgtcgaccggcatcgtcaacatcacgtcgacgacgttctcgggcggcgcgacatgctcgctgatcaacggcagcgcgagcagcacgtcgccgtggacggggcaggccgacagcacgacgcaattgtcgatcaacaacgtgaaggtgaacgtcacgctgctcggcacctgcgggccgagcaaggttgtcacgacgtggagcgatacgaactcttcgctgacgttcaataacgccacgctgacgccggattgcacggtgggcggcacggtgctgacgtcgccgaagttccacgtgcagtaagcgtcgcggatcgaagcgggtacccgccgcgcgcgagggccgtgcgacaggtgcggcgggtatttgcagcctcgatgggtccgtgccgtcgtgcgcatcggcgcgacggccggattcattcgacagagcggccgcgattcggggcaggccgccatacatcgagagagggcctcacagatgaaaattcgtcgaatcacgtcgcttgtcgcggctgtggcattcaccgcggtttcggctgcgcccgcattcgcggtgaccgtttcgcgtgctgacggcctgccgatgaatcccaatggcgaaccgttttccgcgtcggggctcacatcgctccagaagggcgcgttcagtccgatcaactgtacgacgacggtcaacggcaccgtcacgccgaccggcatcgtcaacatcacgtcgacccagttcaccggcggcacattgtgcgtgttgttcaccggtagcgcgagcagtgcggcgccatggacgggaaacgtggacagcacgacgcaagtgtcgatcaacaacgtgaagctggacatgcgggtactcggtacttgtggaccgagcaaggtcacgacggtgtggagtgatccggactcgcgcgtgacgctcaacaacgccgtgctgacgccggattgcacggtgaacggctggctcgcgacgtcgccgaagttccacgtgcagtaagcgtcgggcatcgatgcgggaactcgccttgcacgaaggccgtgcgggatgtgcgcgggttgccgcttcgtcgatgcgctcgagccgtcttccgtatcagcgtgacgacaggctggccgcacgtatcgcgatccgatgcgtgtggcgttgcagggtcggtacggcgtaccgcgccatccgattcgactgaattaccactattccaaattggccagaactatcccggaagacccatgcttatcgatccagcaaagtatggcgatgcccgcggcgcgacgcctgaccggctgcgcacggccgcgtggctgcagtacctgatcgaatatctcgacgctgccgcttgcgtagcgatggcggctgacggtggtgacacgaccgttgccgcgtcgcaggcgatacggatgcggacaggcgcgaatctgtcgcgtgacgcaacggccgtgcttcacgggctcgcgccgtggatcgcatcggacggcggcgcctgcgaatgcgacctgaccgacccgcgcggcgcatgctcgcatgtgccttcgatacggcaactcgccgaagccgaacgctgctgccccgggtcgcgtgccgcgttcgacaccgcacacggcgtgatcgatgcatgcgcattcgatgatcccgatgtcggctgggccgcactcgggcggattgccggcggtctcgaatgcagcgggggatgccggcacatgcaccgcacatgagacgggcgcgcagggcgacacgctgcctgcgaagaatctgagagacaggctcgccgtcatcgcggcggcgagcggagaaatgtcgacccagccgggcgccgtcatcgacgcgatcgtgctgcgtatgtgcgggccgcgcgacgatgcatcgcgtatcgacgagatggctgcgctcgtgacgttctcggccgtgctcgctgccggcgacggggcctccatcgccgcgtatggcggtcagcacaacctcgttgcgcgggcgatccgcacgcatcgcgccgatctggcgtcggtggacggggtgctcgcggcgttgtccgtgtgcaggctggatcgactcgtcggcgcgggcagctttgggcttattacctgctggcgggtatcgcgatcgcagcgcctgacgccgtgcggaaatcggtcgccattttcatggcgacgagtggcaggcgtgcctcgatcacgtgctcgcgtggccggcggtcagccgcttcgggccgaaggaggacgtcgcgttcgatcacctgcgtggcgcaatgagcctgacatcgcgatggaatccgatcgtccgcgggaagcggatgcggaagcaggccggtgttgcgccctgattccacgagcaagggggcaaggccggctgacgcgccagcttttccgaagcctcttccgaagtaatccgcaaggatgccaaacgatttgtggacgcgcatcctgattcgcgcgccatgccggaccccgttcgctcacgcgaacgggcatcgggcggcagcgcgccgagccgacatgccgtcaccagtccacactggccgcacaccgcacaccgcacaccgcacaccgcacaccgcacaccgcacaccgcaccatccatcccgcctgcgcccccgattccggcgccatcgcccgaacgcagtatgattccgcagacgatgccggcgaccgcttcgacgtcactgcccgcccgcgtcgccgaagatctgccaagcttgctgtaagccggacgcaaacagccgccgtgtgagagcgccgccgcgaacccgcgttccgaccaccttcatcgaaacggtcagtcagatgtcaaagcaaaacaagaagatcctcctcctgagcgtcagcgccggcgccggccatacccgagcggccgaggcgatccgcgcattcgccgaccaccatcccgccggcatcgaagccacccacctggacgtgatggatttcgtgtccaccggcttccgcaagctgtacaccgatctctacatcaagctcgtcagcagccagccggcgctgtggggctacctgtaccagaagacggacgaagtcgatcccgccgccccgtcgcagaagatccggcgcgcgatcgagcggctcaattgccggccgctgctcgcggagatcgaacgccagcgcccggacgcgatcatctgcacgcacttcctgccggccgaactgctgtcgcgcgagatccgcaaggagcgcgtcgacacgccggtgtgggtgcaggtcaccgatttcgacctgcacagcatgtgggtcgtgccgaacatgcgcggttatttcgcggccaacgacgagatcgcgtggcgcatgcatgcccgcggcatggcccctgaaacggtgcacgtcagcggcatcccgatcatgccggcgttcggccagccgctcgatcgcgcggcctgcgcggccgagtacggcctcgatcccgcgcgcccgaccttcctgatgatgtccggcggcgcgggcctcggcgggctcgacgtgctggcggcgcgcctgctcgggatggatgccgacttccagctgatcgcgctggccggcaagaaccaggcgatgctggcatcgttgcaggaactggccgtgcaacatccgggccggttgtttccgcagggcttcacgcagcaggtcgagcgcctgatggcctgcgccgacctcgtcatcacgaagccgggcggcctgacgacgtccgaatgtctcgcgatgcagttgccgatgatcgtcaactcgccgattccgggccaggaagagcgcaatgcggatttcctgctcgaacagggtgtcgcgctgaaggcgatcgacgacgacgcgctcgtctaccggatccgcgcgctgctgcaggcgccggagcgtctcgccgacatgcgccgccgcctcgcgccgctcggccggccgctcgccggccgcttcgtgctcgatcgcgtgctgggcctggagcccgccgcatgagcggcgcgcgcttcgtgccgacgcgccatacgctgtttgtcgttgcatgggtcgtgttgctcgcgtatttcttcgcgaacgtggagatccagatcgaaggcagcgcgggctgggcggccaacctgccgacgtggcgcatcgagcatcactggctgctcgacatcttctggggcgggcggccgatgaccggctaccacgcgtgggtgttcccgttcgtcgcgctgttctttcactggccggccgtgttcaacggacggtggtcgtggcgcatcgaagcgcggatcgtcgcgtgcatcatggtgttctggctgaccgaggatttcctgtggttcgtgctgaatccggcctacggtctcgcccgcttcaatccggccaacgtgccgtggcatatccattggttcggcgtggcaccgaccgactactggacgatgagcgccgccgcgatcgtgctgttcattctttcccgcgagcgcaagcgcgcgttctactgatccccgacctgacatgaaactcgccttcattgccgtgctttccgtcacgctcgccgggctcgtgcagccggcccatgcggacccggcctccgaggtgtccgcccggccgaggccgatcaaatgggcgcagggtgtgaccgatgcgcatgtgaacaacctgcatcggatcacgccgacgctgtaccgcagtgcgcagctgtcgcgcgcggatgtgccggaaccagaagctcggcattcgcaaggtcatcagcttccgttcgtttcacgcggacgacagcatcctggccggcacgcagatcaagatgcagcgcatccggatcaacacctgggacatccgcgacgaagacatggtcgcggcgctgaaggcgctgcgtacggccgaccaggacggcccggtgctgatccactgccagcacggcgccgatcgtaccggcctcgtgtcggcgttgtaccggatggtgtaccagggctggacgcgcgagcaggcgctcgacgagctgcagcatggcggctacgggttccatccgatctggcagaacatcacgaactatctgaagcgcgtggatgtcgagcggttgcggcaggaggtcaatagcggctgagccggaaaggaaaaacgccgccgacgggaaccgtcggcggcgtttctttgggcggccgggcaacacggccgccgtcgtcaaatcgtctccggctgccgcacggccttcgcgacattccgcgccatcgccccattcgcgacgaaataaggcacgtcgacacgcgcgagcggctgcttgccacgaatcttgtccgcgattttctccgcgatcatgatcgtcggcgcattgaggttgccggtcgtgatgatcggcatgatcgacgcatcgaccacacgcagcccttccagcccgtgcacgcggccttcttcgtcgaccaccgccatatcgtcgtaacccatcttgcacgagcacgacggatggaacgcggtttccgcgcgggcccgcacgaacgcgtcgagttccttgtcggtcttgcagtccgcgcccgggttcagctcgcggccgcgatagcggtcgagcgcgggctgccgcatgatttcacgcgtcgcgcggatcgcatcgcggaactcgcgccagtcgagcgcttcggccatgtagttgaacaggatgctcggatgctggttcggatcgcgcgagcgcagcttcacgcggccgcggctcggcgagcgcatcgagcccacgtgcgcctggaagccgtgcatctcgatcgcgttcgagccgttgtagttgatcgccaccggcaggaagtggtactggatgttcggccacaggtcgtcgtcgcgcgtgcggatgaagccacccgcctcgaagtggttgctcgcgccgaggcccgtaccgttcagcatccattcgaggccgatcttcggctggttccaccacttcagcgccgggtacagggagacgggttccttgcactcgtactggatgtacatctccaggtgatcctgcaggttctggccgacgccgggcaggtcgagcacgacgggaatgtcgagctccttcagccacgcgccggggccgacgcccgagcgctgcagcagttgcggggacgcgatcgcgccgctgcacacgagcacttcgcggcgcgcgtgcgcggtcgcgcgttcgttgccgcgcaggtacgtgacgcccgatgcgcgcttgccgtcgaacaggatgcgatcggcgagcgcgtgcgtgacgatctcgaggttcggccgtgcacgcgcctggtcgaggtagccgcgcgcggtgctcgcccggcggcccttcggcgtgacggtgcggtccatcgggccgaagccttcctgctgatagccgttcaggtcgtcggtgcgcggatagccggcctgcacacccgcgtcgaccatcgcctcgaacagcgggttcacacccggcttgctggtcgtgaccgacacggggccgctgccgccgtgatagtcgttcgggccgacgtcgcgcgtctcggctttcttgaagtacggcaggcagtcgagatacgtccagttctcgaggcccttgtgcgtcgaccagttgtcgtagtcaagcgcgttgccgcggatgtagcacatcccgttgatcagcgacgagccgccgagcccctgccgcgcccgcattccatccggcggttgtccatgtgcggctcggggtcggtttcgtacgcccagttgtagcggcggccctgcagcggataggcgagcgccgccggcatctgcgtgcggaagtcgaagcggtagtcggggccgcccgcttcgagcagcagcaccgtcacgtccggatcttccgtcaggcgcgttgcgagcacgttgcccgcggaacccgcgccgcagatgatgtagtcgtattcgcgtgtcgtcatgacggtcaatctcctttcgtgatccttaaaacaccgggttgtagcggccgagctcgacctgcaccgacttgattcgagtgtagtgctcgagcgtcgtgatgccgttctcgcgtccgacaccggattgcttgtatccgccaaccggcatctcggccggcgattcgccccacgtgttgatccagcagatgccggcttcgaggcgatggatcgtgcggtgcgcgcgcgacaggttctccgtcacgacgccggctgcgagcccgtagtgcgtgtcgttcgcgcgggcgatcacttcgtcttccgattcgaaatcgaggatgctcatcaccggcccgaagatttcctcgcggacgatcttcatgtcgtcgcggcaatcgccgaacacggtcggcgcgacgtactggccgccgccgaagtggccgtctgtcaggcgcgagccgcccgcgagcagcttcgcgccttcggccttgccgctttcgatgaagccgagcaccttgtcgagctgcgcggccgagacgagcgggccgaaattggtgtcggcgtcggtcggcttgcccacgcggatgcgcttcacgcgttcgagcaccttctgcgtgaacgcgtccttgaccgaacggtgcacgaacacgcgcgtgccgttcgtgcagacctggcccgagctgaagaagttggcggtgaccgcgatgtcggccgcgcggtcgagatccgcatcgtcgaacacgatcagcggcgacttgccgccgagctccatcgtcacttccttcagcgacgatgcgccggccagcgacatcaccttcttgcccgtctcgacgccgcccgtgaacgacaccttcgcgatgtccggatggcccgtcagcagcgcgccgaccgagccgtcgccctgcacgacgttgaacacgccggccggcacgccggcttccgtgtagatttccgcgagcttcagcgcggtgagcggcgtgacttcgctcggcttgaacaccatcgcgttgccggccgcgagcgcgggcgccgtcttccagcacgcgatctggatcgggtagttccatgcgccgatgcccgcgcacacgccgagcggctcgcgccgcgtgtagacgaacgattcggcgcgcagcggcacctgcagcccttcgatcgcggtggcgaggcccgcgtagtactcgatcacgtccgcgccggtgacgatgtcgaccgcgagcgtctcggcgatcggcttgcccgtgtcgcgcgtttccagcgccgcgagttcgtcgttgcgctcgcgcagcaggtcgaccgcgcggcgcaggatgcgcgagcgctgcatcgcggtcattgcggcccattcacgctggccttcctgcgcggatgcaaccgcacgatcgacgtcggccgcgctcgcttgctgcacctgcgcgagcagttcgccggtggcgggatcgaaggtgtcgaaagtcttgccgctcgtggcgtcgacgtaaccgccaccgatgtagaggcgctgcaaaccgaatacggacatgaggatctccttgagggcgactgcgtcgcgcgtcagtcggacgcgagcagcaggtcgatgtaatcgtgggcgagcttcaatgcagcccgggtgtcgatcgggccgccggcgagtgcgccgcgcagccacaggccgtcgatcagcgcggcgaggccgccggcggcctcgcgcgcctgcgtgcggggcaacgccttcgcgaattccgcgcacaggttcgaatggaggcgccgcgtgttgacgtgctgcaggcgcttgagcatcgggtcgtgcatgctctgcgaccagaacgcgagccacgtcttcatgacgggcgcgctcacctgtgtgtcgtcgaagttcgcggcggcgatcgcgcgcagccgcgagcgcgggtccttgcgtgccgccacgcggcggcgcgtggtggccgaccacaggtcgcgcagcacgtgccgcatcgtcgcttcgagcaggccgtccttgtcgccgaagtagtggctgacgatgcccgtcgagatgttcgcgcgctgcgcgacggacgcgagcgtcgtgccgggcaggcccgcttcgtcgatcgaacgcagcgtggcgtcgatcaactgtgcgcggcgaatctcccgcattccgactttcggcatcgcgactcccttcgcccggacgggccgtccatggaagtcgagagcttagcggtttttattgatcgttcaatcaacaaaaatcggggtctgacggtgacggcgggtgccgggcagacgaaagggcagtcggccctgcgttgtgcaggtgcggaaaaataatcgaaagatggttaagaaaacagaagtttgtttaaaacgctttctgaagtcggcgatcaattcggttaatcgttgcgggtgtcgaagcgattacggaatgaaagaatattgagctgtgtgatattcggtgaaatatggaagccggtcgaagaaacgacgtcacttttcattcatgaaaattcgttttaaataggcgaattaaacggttcaagttattgaatttaaatgaatatcacatgataaggcgggattcgaccggcgctccgcaaacgattgcgatcaccctcgaaaggattccgcttaccataaaaatggcggaataatttgaagcagcggtatttcctgacagagtagagggtatcgttggaatgacttgagtcagtaatattgtccgtattagtatggcgccgcactacgaggaatgaatcgatgccgccggtattgccgcggtgcattggccaatcgcgcgattcggattgcgcgcgaaaaccggcgcagcgattgcgcacctgcagcatgccgcgacgtcgagacgccgcatccaccggagaacgacgatgctgaccgaaaaacacgtggtcccgctaccgaatggtctgaaggtctacgtcgaacggaacgtgttcgacccggcgttcgacacggcgatgctcgtcaacggcgcgctcgcgacgaccgcgtcgttcgggcagaccgtccagtatctcggcgagcggatgaacacgatctgcttcgacctgccgtacgcggggcagtcgcgccagcacaacccgggctgctgcatcctgacgaaagacgacgaagccgcgatcctgcagtacctggtcgagcgtttcgcgccggcctacctcgtgtcggtgtcgtggggcggcgtggcgtcgctgttcgcgctcgcacgcggctgcccgagcgtgcggcgcgcggcgatctgctcgttctcgccgttcctgaacgacgcgatggtcgactacgtgacgcgcgcccgcgaccacatcgcggccggcgagaacctgaaggccgcgcagttgctgaacgacaccgtcggccgctacctgccgcgcatcatgaagctgtacaactaccgctatctcacgcgcctgccgcgcgacgagcaggaccaggtcgcgttccacgtcgaccagatcctgtcgctgcagcccgagcgctacctcagcgagttctcgaacatcggctgcgagctcctgttcctgaacggcgagcgtgacgaatacacgacgcccgccgacgtgcgccagctcggcgcgcacgtgccgcgcgcgcggttcgcgacggtgccggacgccggccacttcctcgatatcgaaggccgcgcgcagcgcgaatacacgcgtgcggcgctgctcgactttttctgcggcgagtcgtcgctcgccgccggcatcgcgctcgccgccgcgcaggcgtgcgtgcccgcgccgatgcacgcgctgtcgtcgtgacgccgcgcgccgtgcgtccggtacgcagcgcgcatccgaattcccatcccaacgaggcaggccagccgtgaatatcgttcagaccatcgccatcgtcgttccctgggccgcgtggctcgcctactggatcgccacttcgcaaggcgtgaaggcgaccgtgcgcaaggaagcgtcgcgctcgcgcacgctgcagtcgattccgctgatcgtcggcggcgcgctgatcatcctgcccgatccgtcgtggcaggcgctcgtgcccgactggcagcgcttcggcctgcaggcgcagtgcgggctcgcggtgctggtcgcgggcctgctgttctcggtgtgggcgcggctgcatctcggcacgaactggagcgtgtcggtcacgctgaaggaagaccatgaactcgtgcgcaccgggccgtacgcgctcgtgcgtcacccgatctatacgggctgcctgatcgcgctcgtcggcgccgcgctgatcggcggcgaatggcgcggcgcgatcggcgtgctgctcgtgttcgcgtcactcgcgtacaaggtgcgcgtcgaggaaagctggctgaccgggtatttcgggccggcatacacgcagtaccgccgcgaggtcgcggcgctgattcccggcttctactgatccccgcgaggcgcgcgatggcgaagatgatcgtgaccgcgatcggctcggcgggcgacgtgcatccgctgctcggcgtcgcgcgcacgctcgcggcgcgcggtcacgacgtcgtgttctgcacgcacgcgccgttcgaggcggccgtgcgccattgcgggttcgaattcgtgccgatcggcaccgcggccgaatacgaggcagcgatggcgaaccccgcgctgtgggattcgcgcacgtcgtttcgcacgctgtggcaggtgatcgcaccgacgctgcgcccgcactacgacgcgctgcgtgcgctggccgacggcgacacggtgctcgtcggcacgctgtgggcgttctccgcgcgcttcatgcaggagctgcacggcacgccgtacgtgtcggtgcaggtgtcgccgtcgacgctgctgtccgcgcatgcgccgccgacccacccgcgcctgacgattcccgcgcgttggccgctgcccgtgaaggcggcgctgatgacgctgatcgagcgtcaggtgctcgatcgcacatgcggccccgcgctcaacgcggtgcgccgcgatctcgggctcgcgcccgcgcggcgcgtgctgggccgctggctgcattccaccgacggcgtgctgtgcctgtttcccggctggttcgcgccgccgcagccggactggccgtcgaatcatctgcaaagcggttttccgttgttcaacgatattgcgactcccgacgacgatgtggcactcgatgcgtttctcgcggccggcgagccccggtcgtgttcacggccggttcgacacgcgtcgatcacgcggcctacgcgcgcgcggtggcggacgcgctgcgcgcgaccggcgcgcgcgggatcctgctgacgccgcacgatgcggcgccggacggcgaccatttgctcgtgcgccgcttcgtgccgatgcgcacgctgttgccgcgctgccgcgcgctcgtgcatcacggcgggatcggcacggcggcgctcgcgttcgaagccgggatcgcgcaagtcgtcacgccgttcgcgcacgaccagttcgacaacgcgcaacgcgtcgcggcgagcggctgcggcgtgcgggtcgacggcccgatcgacggtgcgcgcctaggcgcggcgctcgcgcgcgtgctcggcgagcccgcgtttgcggcgcacgcggcgcgtacacgcgcacggctggcggccgagcgggacggctgcgccgccgccgccgatttcatcgagcggttcgcgccgccgcgcgggcggccagccgcacggcccgaagccgcggtggccggcgcatgagcaccgcgtcgccgcttcacgacgggcccgtcgcggcgtctgcgttcgatgcgccggccccggcgtcggaaccggccgcgcaaccggtgcgcggcatccggctcgcgctgctgacgttcgcgctgtcgctcgcgaccttcatcgaggtgctcgactcgaccgtgacgaacgtcgcggtgccggcgatctccggcagtctcggcgtatcgaacagccagggcacgtgggtgatcagttcgtattcggtcgcggccgcgatcgcggtgccgctgacgggctggctcgcgcgccgcgtcggcgaactgcggctgttcgtcggcgcggtgctgctgttcacgctgacgtcgctgctgtgcgggctcgcgcgcgacctgcacgtgctcgtgatctgccgtgcgctgcagggctgtgctcggggccgatggtgccgctgtcgcagacgatcctgctgcgcacgttcccgccggacaagcgcacgatcgcgctcgcgctgtgggcgatgacggtgctgctcgcgccgatcttcgggccggtggtcggcggctggatcgtcgacaacttctcgtggccgtggatcttcctgatcaacctgccgatcgggctgttctcgttcgcggtctgcaccgcgatgctgcgccccgacgcgcaacgcggcacggccggcccgatcgacgtgccgggcatcgtgctgctcgtgatcggcgtcggctcgctgcaggcgatgctcgatctcggccatgatcgcggctggttcggttcgccgctgatcgtcacgctggcggtggtcgcggggctcgcgatcgtgtcgctgctgatctgggaagcgggcgaagcgcatcccgtcgtcgacctgagcctgttccgcgatcgcacgttctcgttctgcgtgctgatcatctcgctcgggatgatgagcttctcggtggtcggcgtcgtgtttccgctgtggatgcaggccgtgatgggctacaacgcgtttcatgcggggctcgcgacagcgtcgctcggcgtgctcgcgctggtgttctcgatcctcgtcgggctgcatgcgcatcgcttcgacgcgcgcgtgctcgcgaccttcggcttcctcgtgttcgcggccgtgctcgcgtgggatgcgcatttcacgctgaagatgacgttcgcgcagatcgccgcgccggggctgatccaggggatcgggctgccgtgcttcttcattccgctgacggccgcgacgctgtcgcgcattccggacgaccggctcgccgccgcgtcgagcctgtcgaacttcctgcgcacgctgtcggccgcgttcgggaccgcgatgagcgtgacgctgtgggacaaccgcgcgacctatcactacgacgtcgtgtcgcaatccgtcacgcacgcatcggcgaacacgcagcgcttcgtgcacacgctgaacgcgatgggcgtggacggcgtacgcgagctgacgacgctgcaccaggtcgtgatgcagcaggcctacatgatggcaaccaacgacatgttctggatggcgagcatgacgtgtctcgcactcgcggcgatgatgtggctgacgcggccgaagcgtggcgcggccgcgtcgttcgggcattgaggagaggaacatgacgacactcggcgcactcgtgatcctgtatcacccgagcgacgcgcagctcgacgcgctcggcacctggcggcacgcgtgcgatgcgctgctcgtcgtcgacaacacgccgcagcccgatgcgcgggcccgcgagctgtgcgcgcgcgagggcatcgcgctgctgcatcacggcaatcgcggcggcattgccggcgcgtacaacgcggccttgcggcgctgtttcgcgaccacgtcgatgccgtcgcgctgttcgaccaggattcgtccgtgcccgccgcgtatttccccgcgatgcgcgacgtctgcgccgggctcgcggggcgcgcgttcctggccggcccgcgcattttcgacgagaacgcgcgcagtttcctgcccgaactctcgaccaacgggatcgggctgcgccgcttgcgcatcgagccgggcgcgccgctgcagcgttgcgcgttcctgatctcgtcgggctgcgtcgtgtcgcgcgatgcgttcgacgtgctcggccgcttcgacgagacgctgttcatcgatcacgtcgacaccgagtacagcttccgcgcactggcgcgcaacgtgccgctttatgtcgtgccgtcgctggtgctgccgcaccggatcggcgcgaagcagcgtcacgcgatcggcccgttcgaaatgacgtcgatgaatcactcgtggcaacggcgctactacagcgcgcgcaatgcggtgcagctcgggatgcagtacgggctgcgctttccggtggcgatcgtgccgaacctgctgaccgtgtggcaggtcgtgcagatcgcgctcgtcgaacgcgacaagcgcgcgaagctcgccggaatcctgttcggcatcgcggacggcctgttcggccggctcggcccgctcgagcgcacgcggccgcggctggccgagcgggcgcggcgcgtcgagcggcgcattcagcagggatgaggagcgagatgcggcgtgtgaaacaagcagcgggttgggcgcatcgcatgaagggcggcacggtgatcggtgccgcggcggtgtcgctggcactgggcggatgcgtgccgacgggcttcctgccgtcgctgtcgttgcatgcgccggccgacgatgcgctcgcgcagacggccggccccggcgtgaacggcgcgtggcccgcgcccgactgggtgaagcagttgcaggatccgcagcttgacgcgctggtcgccgaggcatcgcagaacaaccccgacctgcaggttgcgcaggcgcggctgcggatcgcgcaggcgcagcttcagcagttcgattcgttgacggggctgaccggcacggccggcgcaacgatcagccgcgcgcggatgccgaagccgggcgacgacgtcgccaacgtgtcggtcggcggctatcgcgtgccggtcgagatcttcggcgatccgaacgtatcgccgtcgtcggtgttcgtcgggctcaactaccagctcgacctgtggggcaagaaccgcgccgcgacgaagagcctgatgtcgctgcgtgaagcggcgcgggtcgaggccgagcaggtgcggctcacgctggcggtcgcgatcgtcaccgtgtactgccagctcgaccaggcctatgcgatgcaggaactgctgcagcagaagctgaaggtgagtcagcgcgtgacgaccgtgctgcgcgagcgcaccgcgcgcgggctcgacaacgcatacgacgcgagcgatgccgcgatcaagcgcagcaagctgctcgcgcagatcgcgcagaacgacgagcagatcaagctcgcgcaactgcagctcggcgtgctgtcgggccgcggcccggagcgcgggctcgcgctgcagcggccgcgcgtcggcgcatttgccggcggcgcgctgccagcgcggctgccggccggtctcctcggccgccggcccgacatcgtcgccgcgcggttgcgcgtcgaagccgcgttcgcgaatgccgattcgacgcgtgcgcagttctatccggacgtgaacctcgtcgcgctcggcggcgtgttcgcgctgacgcccgcgtcgctgttctcgcgcgacgcgctcgccggttccgtcggaccggcgatctcgctgccggtcttcgatcgcggccggctgaaggcgaagcttggtgcggacgtcgctcaggccgacgtggcgatcgggctgtacaacaagaccgtcgacgacgcgctcgggcaggtcgcgcaactcgtcacgtcgctgcagacatcgcagacgctcgtcgcgcagcagcaggatgcggtcgcggccgcgcaaaagatcgtgcagatcgcggccgaccgccaccggcgcggggtgctgatgcagaaggacgtggatgtcgcggatctcacgctgatcgacgagcgcgcgcagttgatcgcgctgctcggccggcagcgcacgctgcgtgtcgggctggtcggtgcgttgggcggcgggttcgatgcgggcgcgacggtcgcgcaggcgccggccgcgcatcgggcgcgtagcggggcggcgaagcgaggtgcgtcgaccgtcgcacccgccgcgcccgcgatggcggctgcgaccgccacgaccgcatccgccgcgaacgcgagcacatcggtggcggggccgtccgccgatgcgcgtgcgcggagcgtgtccgtcccgcaggtcgtcgctgcatcggataccggggccgcacgacgcgacgacgcggcacgcacgccggccgtcggcgcgacgcctcgcggcaccccgttcccgcgcgcacggcggccgcgactccggcgccgagcctgtcggtcatgccgccgatcccctgttccagcacgatcgtctgatcgtcacgcaaagcgactgatgcaccacgacaacctacataccgccgcgccgccggccgcactgaacgatcctgcactcgacgcgcgccgcgcgacgcgtcgcaagcgcttcatcgtgttcttcgcggtcgtgctggtggccgcgcttgcatggatcgcatactggttgctgagcgatcgctattacgaagacaccgacgatgcgtacgtggccggcagcatcgtccaggtcgccgcgcagatcccgggatcggtgaccgacgtcgtggtcgccgatacgcaggccgtgcgcgccggccagacgctcgtgaagctcgacgacaccgaggcgtccgtcgcgttcgcgcaggcgaaggcgcagctcgcacaggccgtacggcaggtcgcgaacgcgaagatctcgaacacgatgtacgtcgaggccgtaaacgcacggcgcgccgacctgtcgctcgcgcagcgcgcgtttgccgcgcgctccggcgcatcggtcgagatcgtcgcacccgaggagctcgcgcgtgctcgggcggcggtcgccggtgcgcaggcgaatctcgcggccgcgcaggcgcagctcgacgcggcgcgcgcgctcggcaccaggctgcccgtcgacgaaaacccggccgtcgtgcaggcggccgcgcagttcaagctcgcgtaccgcaacctgaagcgcacgacgatcgtcgcgcccgtcgacggcacgatcgggcagcgttcggtgcaggtcggccagcaggtcgggcccggcgtgccgctgatgtcgatcgtgcagctcaaccggctgtggatcgaggcgaatttcaaggaagggcagatccgccacatgcgcatcgggcagccggtcgaggtcgtgtccgatctctacggctcgcgcgtgacctatcgcggccgtgtgcagggcttctcggcggggacgggcagcgcgttctcgatgctgccgtcgcagaacgcggccggcaactggatcaaggttgtgcagcgcgtgccggtcgtcattgcgctcgagccgcgcgatctcgccgcgcatccgctgcgcgtcgggctgtcgatgcgcgcaacggtcgatacgcacgaccgcaacggccacgcgctcgacagcgagccgccgacgccggccgtcagcacgcgcgtgcatgacggggtggcgagcgacgcggaagcggcggcggccgcgatcattcgcgagaatcagggcgggtagcgcctgccgggagagggcggccggtcacgacgaccggcctgcccccgcgcgtcacgccgcccgcgaaacctttccatcgtttcccgcccgactttcgcatttccgccatcgatgtcggcgccgttcaaacgcgtgtcgcgtttgagacatcggcgcccctgcctccgggactactctcgaacagcacgttgcgcgtgcgccggatggcgccggcgcgccgcggcgccaccaacgagacatggagacaatacgatgagcagcaatcgaggtgtcgtctatcttggaccgggccaggtcgaagtccagaaaatcgattatccgaagatggtcgatccgagcggccgcgcgatcggccacggtgtgatcctgaaagtggtcagcacgaacatctgcggttccgaccagcacatggtgcgcggccgcacgaccgcgccggtcggcctcgtgctcggtcacgaaatcacgggcgaggtggtcgagatcggccgcgacgtcgaaacgctgaagctcggcgatctcgtatcggtgccgttcaacgtcgcttgcggccgctgcgcgatgtgcaaggacacgcatacgggcgtgtgcctgaacgtgaacccgtcgcgtgccggcggcgcctatggctacgtcgacatgggcggctggatcggcggccaggccgagtacgtgctcgtgccgtatgccgatttcaacctgctgaaattccccgaccgcgaccaggcgatggcgaagatccgcgacctgacctgcctgtccgacattctgccgaccggctatcacggcgcggtgagcgcgggcgtgaagccgggctcgacggtctatatcgcgggcgcaggcccggtcgggatggcggcggccgcatcggcacgcctgctcggcgcggccgtgacgatcgtcggcgacatgaacgcggaacgcctcgcgcacgcgaaggcgatgggtttcgagacggtcgacctgtcgaaggacgcgtcgctcggcgagcagatcgagcagattctcggtgtccccgagatcgactgcgcggtcgactgcgtcggcttcgaggcgcacggccacggctcgtcgggccacgcggaagaggcgccggccacggtgctgaactcgctgatggaaatcacgcggccggccggtgcgatcggcatcccgggcctgtacgtgacggacgatccgggcgcgaaggacaaggccgcgcagcacggcagcctgagcatccgcttcggcctcggctgggcgaagtcgcactcgttcttcacgggccagacgccggtgctgaagtacaaccgcaacctgatgcaggcgatcctgttcgaccgtctgccgatcgcgaagatcgtcaacgtcgaagtgatttcgctcgaccaggcgccggaaggctacaagaagttcgacggcggcgcgccgcgcaaattcgtcatcgacccgcacgggttgctggcggcgtgatgcgctagcgttcgacgcgcgcagcgcgtcacgcgaaacgggcggcaccggaaacgggtcgcccgtttttactgaggaagcacgggaagggcaggccgcgcgcaggtatcgcgcgggccggaacgcctgcgcaccgccgatcccggccgcacggaattgctgcgataatcgtcgcccgttcccgactccatcgcggccgcccggcgccgaatccacgaatggccaagtcacttccctcgccgcgttgcacacgttcgtcgaagtggcgcgctgcgccagcatgaagcaggcggccgaccagctctgcatttcgccgggcgccgtcagccagcacgtccgcaatctcgaggatcgccttgccgtgcgcctgttcgagcgcaccggccgcgagctcgagctgaccggcacgggccgcgcgctgttcgatcagctcgccggcggcttcaacgagatcgaggccgcgtgggcgaacgtgcacggtgccaatcggcgcatcgtccgcctcgccgtgacgaccaccgcctccttcgcgaacacgtggctcgtgcagcgcctcggcgcgttcaatgccgcataccccgaaatcgaaatcaccgtcgaaacgcgcgcgcaactggtcgacctgcgtcgcgactatgtcgacgtcgcgatccggcacgggttgggccattatcccgggcatgcatcgttccgcatctggacacccgagctgtggcccgtctgcagcccgcgactgctcgatcccgcccgcccgatcgccacgccggctgactgcctgtcgtatccgctgctgcaggacgcggaccgcgccgactgggcgctgtggctgcgcgcgcagggaatcgaggatgcccgtgcgccgcgcggcgcgagcttcagcgaggatgcgctgctgatcaaggcggcggtcgccgggcagggcatggcgctggtgcgcgacatctacgcgcgggacgaagtcgcggccggccggctggtgcgcgtgctcgcgcggccctggccgaccgaactgtcctattacgtcgtgtgcagcgaagcgcgccggcacgagtggaagatcgccgcgttccgcgactggctcgcgagcgagatcggcggtggcgacgacggcccgcgcgatctactggcgtgacccgcgcacggcggcggccgcgaaccccttgagcttgccggtcgcgagcgcggtgccgagcaggatgatcgcgcacccggcgaccgtctgcacggtgatcgtctcgtgcaggaagatcgcgccccatacgacaccgaagatcgggatcaggaacgtgaccgacgccgcatattgcgcgcccgcattgcggatcagcccgaaatacagcaggtaggcgacggccgtgcagatcgcgccgagcagcaccaccgcgatccacgcggacgcgtgaacggggccgtgcggccacatcggcagcgcgagcggcacgagcgcgaccgccgcgaacaactggctgccgaacgccgacacgaacggcctgacattcgccagcttgcgcttcgagtaatgcgcggcgaacccgtacgacagcgtcgcgagcatcgcggcggcgattgcgcgcggtgcgccgggcgtgccggcgccgaccgcggagccggcgagcacgacgacaccggcgaagcccagcgcgaggccgatcgcctggggtttcgtcagcggtgtacgcagccatgcgaatgcgacgatcgcggtccacaacggtgtcgttgcattcaggatcgaatcggtgccggccgtcacgaacagcgccgcgtaggtcagcaggcagaacggtagcgccgagttcgcgatgccgacgacgaacagcggcacgacgtgcgagcggaattcctgtcgcgcctgcgcgttgcgcagcaccggcgacaacagcacggccgcgatcgcgacgcgcagcgcgatcagcgggaccacgccgaattccggtgcacccatgcgcatgaacaggaaggacgcgccccagatggcagcaagggtcacgagctgtagtgcattcatcgacgactccgttcggtggatcgggtgagcggccggaacgcgatacgcgccggcgcgggcgaatgatccattgaacgtcacgcgtgcgtcgcggcgcaaacgaggttttgcgagggcggtttagaaaaatgaatcgacgcaagcgtgcgcacggacggcgcgtgcgcgctcagtggccgcgatagagctgggcgagttgcgtattgctggcggtggtggtgcgtcgcgcccgcgcggtgtgtgcggtgtgcgcgctcactcggtggaatgtgcgggcgcgatgcgcggcattgcgaccggctttcaggtccgccacccgaaccggggtggcggcatgcggccgatcgggtgcacggatggccggcgcggcccgcgcgactgtggtccgtccggcggcttcgccgacatccgggctgcgctgtcgcgcggccgccacctgggttccatcagtcgaatgaaacggataggcgggcgccggcaggaccggcagcacgggatcgttcgatacgtacgcacccgcatcgctcgccgtcgcgcccgatatgttcgagccgcgacagaccggatcggcattgcacgtccggtcgaccatcacgtagccgccgaccagcagcacgagcgtcaggatgctcaggatcggcgcgctcgatgcgcgcggccgccggaacgccgcgttgcgaagcgtccgcgcgacgcgcgacgaccacgtatcgaagcgctgcaccgcgtgcatggtgtgcgcgtcgtccggcgtgcggcgaaccggatcgaacggccagttccactggccgcaaacggggcaatgctcgagcgcgcggaaggccacgaagccgcattccctgcagcggcagccggcagtgcgccgcgcgtcggctcgcgcgttcaggatcgcgcgccagtcgtcgcgtgcgcggaacgtccgattgggcaggactcgcatcgccggaagcgggcaggcgccgtcaacgaggcgaacgttcgccggtcgacatgacgctttcctgcaaggcaaccgatcggcccgtgccggaatccggcggcgcgtgcatcgtcgacggtcgtgcacatgcggtgctcatgggattctccgtgacgtcgggtgagcggagcacgttcttccgcggttaccttccgcttcattcttggtcgcctgcgtgtgaaacgcaatgcgcaaaaaggagcatcgcgacgtgcacgtttcgtgctatccgtcctgccgctgccgggccgcgagcgtcccgatggtctccatcgcgtgctcgacggccggtgtccacggccggccgtaatttagccgaagatagcggcggaatccgccggttgcggaaaagatcggccccggcgcgatgctgacgccgttttccatcgcatcgtcgaacaggtgcatcgcatcgacgcgcggcggcagttcgatccacaggaaatacccgccgtgcggcgcgaacacttcggtgccgtccggaaaatacgtctgcacggccgccagcatctgcgcctggtgcgcggcgagattgcggcgcagcttgcgcaggaagcggtcgtacgcaccgtcgcgcaggtagttcgaaatcgccatctgtgcgggcgtcggccgccggcgcgctcgcgcctcttgcctgacggatttgccgcacgtagcgtccggccgcgacccagccgatccggaacccgggcgcgaggcatttcgagaacgaaccgcaatgcaggacgagcccgctgtcgtcatacagtttggcggggcgcgtgggtgccgttccgaaatgcagctcgccatagacgtcatcctcgatcagcggcacgccgcgcgccgtgagcaggtcgatcagcgcgcgtttgcgctcgtcggtcagcgtcgcgccggtcgggttgtggaacgacgtcatgaaccagcatgcccgcaccggatgcgtgtcgagcgctgtttcgagcgcatcgagatcgaggccggtgcgcgggtcgaccggaatctcgacagccttcaggtgcaggcgctgcacggcctcgagggccgcgtggaatgccggtcgctcgatcgcgacgatatcgcccgggcgggtcagtgcctgcaggctgagcgtcagcgcgtcgagcgcgccggtcgtgatgacgatctcgtccatcggcaacgccgcgcctgcgttcaggtagcgcagcgcgatctggcggcgcagcgtgtcgtagccgggcggcaagccggacagcagcgtcgtgcgatccatgttgcgggccgccgacgccatcgcgcgccacaggctgctcatcggaaacagggaatagctggcgaaggccgagccgagcggaacgatctcgtcgcgtttgagcgagtcgagcaggcggaacagcacatcgtcgccgccggttggctcggcggccggcttgcgcggcggatcgtgggcgaaccgcacgcgcttgtcttcgaggttcgcaacgaaataaccggatcgcgcccgcgcgacgatcagaccctcgccttcgagcgcgtagtacgcgcgaaacacggtggacgggctcacgccatacacgcggcaggccatgcgcacggtggggatgcgcgcaccgggcggcaggtcgccgcggtggattgcgtcggcgatcgttcgtgcgagcacagcgtatcgcttcatgccagccctccgcccgatcggggccttgccgaaaaagagtagcacggcacccgtcgcgtgcaagcgcgccccaattgctgatccgcatgtttttgccgggctctgattcttttctttcgtctgacaagccggcatgctgtcgagcaatctgcgttcccgatgtccgaccgaccggaatcgacgctgcccgacggcggattcctggcccgcgcacatcctgcgcgggacctttctgcggcgtcacaaccttgcccggaatcattcagcgtgaaattgaagactcgtcgccggcctcgtggccggcatcgccctcaacctgtcgagcggcatcgcaacggccgcctgcatcagcaatcccgccgcccagccgaacgcgacgttccccgccgcactgaccggcaagctcgtctaccacagctacgtgaagtacggcgacggcacgagccagctgttcctctacgacttctcggcccatacgctgacgcaactgagcaagagcacgtggggtatcaccgatccgatgaacggcgtgttcagccccgacggcaagtggctcgcgttcatgggcatcagcaacggcgcatggaacgtgttcatgctgcagctcggcgccggtacgccgcccgtcaacctgacgaacagcacgggcgccacgcgcaacgaggatcgaagttcagcgccgacggcaagacgctcgtgttcaagcagaacggcgacgtcaagcaggcgacgctgtcgtacacgagcgcgggcccggcgttcacgtcggttgtgagcctgacgaacgcgccggccggcgccgagtattcgatgccgtatctcgcgcccgattcgagcgccgtgtactacgcgacgggcaccggcgcgaacatggggctgatgaagcgcacgctcgcgaccggcgcgaccgcgacgttcgacaatccggccgggctgcagacgtactacccgatcgtgcgtgcggacggcatggtgttctacgcgcgctggaaagacagcggccaggccgaccagatctatacgaagaccgcggacccggcgtcgacgccgaacgcgttgccgatcaacgactgcatgagcaacaactcggatccggcgccggtgaacggcacgaactacgtgttcttctcgtcgacgacggcgggcggttatcagctctacgtcggtgacgtgacgaccggccagcgctggagcctgtcgcagttcggcgtgaatgccgacacgacgaaggccaagctcggggcgagctattacggcggcccggccgccgcgcagccggtgctgctgtcgcagggcatccggccgctgcgtcggcgagctacaacgcgtcgctcacgccggacaaggcgttcgacggcaacaccacgggcacgcgctgggattcgccggaaggcgccggtgtcggttcgcaatggatctccgtggatctcggcgctgtgaagcgcatcgatcacgtcgatctgtactgggatgcgggcgcgctcgcttatcagatccagacgtcgaacgacaacgccaactggacgacgatctattcgacgagcaacggcggttcatatacccacgtcacgctgccgaatctcaacggcagcggtcgttacgtgcggatgctcggcacgaagcgcgcgacgcagtggggatactcgctctacgaaatgcaggtgtggggatcgtaagcgcaaagaaaaacggccttcgaggccgtttttcatgcgtcgatcacagcgacgctcacgcatgcagcacatgcgccgggaaggcggggccggcgctcgccgcgccttgcgcaagcggcgcgacctgcttgcggcgctccttgtcggcgcgacgccgaacgcgtcgcgatagctcttgctgaaatggcacgccgactggaatccgcacgccatcgtgatgtgcatgatcgacatgtcggtctgcagcagcagttcgcgcgcgcggcgcagccgcagcgtcaggtagtagtgcgtcggcgtcatgccgaggtgttcgcggaacaggcgctgcagttgccgctgcgacatgttcgcgagccgcgcgagctcctcgcgcgacagcggctcttcgatgttgttctccatcagcgagatcacttcgaacagcgacttgttcgccgagccgaggcgcgcgacgagcggcatgcgttgctgcgcgctcgtgtcgcgcacgtgttcgacaatgaactgctcggcgatctgcgtgacgcgcgcggtgcccacgcgtgcggcgatcaggttcagcatcatgtcgagcggcgcgacgccgcccgtgcacgtgatgcggtcgcggtcgatcacgaacagttccttcaggaagcgcgtatccggaaactcctccttcagcgccgacatgttctcccagtggatcgcgcatgcgtagcccgcgagcagccccgacttcgcgagcgcataggtgcccgtgcacaggctgccgagcgggatgcccgcgcgtgcgaagcggcgcagcgtcgacagatgggcgggcgtggtcgcgcgttgcacgtcgacgccgccgcacacgaacacgatgtcgggctgccccacgcattcggccgggcccgtatcgaccgtcaggccgttgctcgcggtgaccgggccgccttccgggctgatgaccgaccagcggtagagcggctggccgctcaggtagttcgccatccgaagcacctcgatcgcattggtgaacgcgatcatcgtgaaattcggtaacggcatgaacgcgaagtgggacagcgacgctgtgcggtcggggacatggggagcttcctgaaatctctaatagctataggcccggggcacggatcgggctgcggtattgtgtgagccagcgcaacaagcgtgccatacggctaaaccctagctccatacgttgtatggctgaaagccgcatgctgcactgcaccgtattcgtgaggcagtgcaccccgaccgggcggcaatcgcaccgccggcgtgcctgttcataggtgaaccgtcgacggcgatttgcttggtcatccgaaaaagcacgaccggtcacttgtataaaacggacgcggatggcggaaaaggcaaagaacgcgtctaaattcatcaatccgccgaaaatccgaacgacaagaatagagccgtcggcagccttgtacgggacaagcgggaaacccaggcagggcgggccttgagcttcggtttcagccccttattcttcgtcacggacgcactatgtcgaacacccagcctttcttctcgcagtcccttgccgagcgcgacgcgccggtgcgcagcgccatcctgaaggaactcgagcgtcagcagtcgcaggtcgagctgatcgcgtcggaaaacatcgtgtcgcgtgccgtgcttgaggcgcagggctcggtgctgaccaacaagtacgcggaaggttatcccggcaagcgctactacggtggctgcgagttcgcggacgaagtcgaggcgctggcgatcgagcgcgtcaagaagatcttcaatgccggttatgcgaacgtgcagccgcactcgggcgcgcaggcgaacggttcggtcatgctcgcgctggccaagccgggtgacacggtgctcggcatgtcgctggatgccggcggccacctgacgcacggcgcgaagccggcgctgtcgggcaagtggttcaacgcggtccagtacggcgtgaaccgcgacacgatgctgatcgactacgaccaggtcgaagcgctcgcacacgaacacaagccgaacctgatcatcgccggcttctcggcatacccgcgcgcgctcgacttcgcgcgcttccgcgcgatcgccgacagcgtcggcgcgaagctgatggtcgacatggcgcacatcgccggcgtgatcgccgcgggccgccacgcgaacccggtcgagcatgcgcacgtcgtcacgtcgaccacccacaagacgctgcgcggcccgcgcggcggcttcgtgctgaccaacgacgaggacatcgcgaagaagatcaactcggccgtgttccccggcctgcagggcggcccgctgatgcacgtgatcgccggcaaggcggtggcgttcggcgaagtgctgcatgcggacttcaagacctacatcgacaacgtgctcgcgaacgcccaggcgctcggcgaagtgctgaaggcgggcggcgtcgatctcgtcaccggcggcaccgacaaccacctgctgctggtcgacctgcgcccgaagggcctgaagggtgcgccggtcgaacaggcgctggagcgcgcgggcatcacctgcaacaagaacggcattccgttcgacaccgagaagccgaccgtcacgtcgggcatccgcctcggcacgccggccggcacgacgcgcggcttcggcgtcgcggagttccgcgaggtgggccgcctgatcctggaagtgttcgacgcgctgcgcgcgaacccggaaggcgaccacgccaccgaacagcgcgtgcgccgcgagatcttcgcgttgtgcgaacgcttcccgatctactgatccgaccgacccgacaatactggagccactcatgggcacgctgcatcaagacagcatcatcatcgacggtctgaacatctcgaagttcgagaagccggtgttcgaagacatgcgccgcggcggcatcacggccgcgaactgcacggtgtcggtctgggagaacttcacgaagaccgtcgacaacatcggcgtgatgaagaagaagatccgcgacaacagcgagctgctgacgctggtgcgcacgacggaagacatcttccgcgcgaagaaggaagacaagaccggcgtgatcctcggcttccagaacgcgcatgcgttcgaggacaacatcggctacatcgaggcgttcgccgacatgggcgtgcgcgtcgtgcagctctgctacaacacgcagaacctggtcggcaccggctgctacgagcgtgacggcggcctgtcggacttcggccgcgaagtgatcaccgagatgaaccgcgtcggcatcatggtcgacctgtcgcatgtgggcggcaacacgtcgtcggaagcgatcgcgttctcgaagaagccggtgtgctattcgcactgcctgccgtcgggcctgaaggagcatccgcgcaacaagagcgacgaacagctgaaggagatcgccgacgcgggcggcttcgtcggcgtgacgatgttcgcgccgttcctgaagcgcgggatcgaggcgaacatcgacgactacatcgaggcgatcgactacgtcgtgaacctgatcggcgaggatgcggtcggcatcggcacggatttcacgcaggactacgcgaaggaattcttcgacatgctgacgcatgacaagggccgttatcgccagctgacgaacttcggcaaggtgatcaaccccgacggcatccgcacgatcggcgaattcccgaatttgactgccgcgatggaacgccacggctggaaggagtcgcgtatccgcaagatcatgggcgagaactgggtgcgcgtgttcaaggacgtgtggggcgcgtaagcgccgcgaacgccggaccgcctcacccgcagcgattcaacaacaaaaatcgggacgtgcccgcgcaagccgcgcgggcacgcggacgatgtcgcgcccgcgcattgagccgcgcgacccatttcctcacggagtcaccacgatgcaaccgcaactgccgatcaacgtcgatcccgataccggcgtctggaccaccgacgcgctgccgatgctgtacgtgccgcgtcacttcttcacgaacaaccacgtcgcggtcgaggaagcgctcggcgtcgaagcgtatgccgagatcctctacaaggccggctacaagtccgcttaccactggtgcgacaaggaagccaagctgcacggcctgaccggcatggccgtgttcgagcactacctgaagcgcctgtcgcagcgcggctggggcctgttctcgatcatcgaggccgatccggccggcgcgcgcgcgaagatcgagctgcgccactcgtcgttcgtgctccagcagccgggcaaggaaggcaagctctgctacatgttcgcgggctggttcgccggcgcgatggactgggtcaacgacacgacgccggaaggcaagggcgcaccgcgtgcgcaatcgaaggaagtgcagtgcgcggccgagcatcacgaccactgcatcttcgaagtgtcgccgatcgcgcactgattcaccgctacagaacaacacccgcaacacgagacattcgaacgccagaggtcgccagcgatgcgttatccccacctgttcaaacccatgcagctgaaccagctgacgctgcgcaaccggatcgtcagcaccgcgcatgcggaggtgtatgccgagccgggcggcctgccgggcgaccgctatatccgctactacgaagagaaggcgaagggtggcgtcggccttgcgatctgcggcgggtcgagcccggtgtcgatcgacagcccgcagggctggtggaaatcggtgaacctgtcgaccgacaagatcatcgatccgctcacgcgtcttgccgacacgatgcacaagcacggcgcgaagatcatgatccaggcgacgcacatgggccgccgctcgtcgttccacggcgagcactggccgcacctgatgtcgccgtcgggcgtgcgcgaacccgtgcaccgcggtaacgcgaagatcatcgagatcgaggaaatccgccgcatcatcggcgatttcgcggcggccgcgaagcgcgtgaaggcggccggcatggacggcatcgaaatctcggctgcccaccagcacctgatcgaccagttctggagcaagcgttcgaaccaccgcaccgacgaatggggcggcagcctggaaaaccgcctgcgcttcggtatcgaagtgctgacagccgtgcgcgaggcggtcggcaaggatttctgcgtcggcctgcgcatgtgcggcgacgaatttcatgaggatggcctcgatcacgaagcgctgaaggaaatcgcgcaggcgatgtcggagacgggcctgatcgactacctgagcgtggtcggctcgggcggcgatacgcacaacacgatcgccaactgcatgccgccgatggcactgccgccggagccgttcgtgcacctcgcggccggcatcaagtcggtcgtgaagattccggtgatgcatgcgcagagcatccgcgacgcgggccaggccgagcgcctgctcgcgaccggcatgatcgacctggtcggcatgacgcgcgcgcagatcgccgatccgcacatggtgatcaagatccgcgacggccgcgaggacgaaatcaagcagtgcgtcggcgcgaactactgcatcgaccgccagtacaacggcctcgacgtgctgtgtattcaaaacgccgcgacgtcgcgcgaagcgacgatgccgcacatcatcgagaagtcgcgcggcccgaagcgcaaggtcgtggtggtcggcgcgggcccggcgggcctcgaggcggcgcgtgtcgcgaagctgcgcggccacgacgtggtgctgttcgagaagaacgccgaagtgggcggccaggtgatgatcgccgcgaaggcgccgcagcgcgaacagatgtcggggatcatccgctggttcgacatggaaacgaagcgcctcggcgtcgatcgccgcctcggcgtggccgccgacgagaagatgatcatggccgagaagccggacatcgtcgtgctcgcgacgggcgggtcgagcttcacgtggcaggtgccgggctggggcgtggccgagggcctcgccgtcagctcgtgggacatcctgaccggcaaggtcgagccgaagcagaacgtgctgctgttcgacggcgtgagcacgcatgccggcgcgggcgtggccgacttcatggcgagccgcggctcgaaggtcgaggtcgtgacgccggacgtgaaggtcgccgacgattgcggcggcacgacgttcccgatcttctatcgccgcctgtatgcgttcggcgtgatcccgacgccgaacacgatgctcgatcgcgtctatgaagaggacggcaagctgatcgccgtgctgcgcaacgagtacacggaagaactcgaagagcgcgccgtcgaccaggtggtgatcgagaacggttcgtcgccgaacgacgagctgtactggaagctcaagccggaatcggtgaaccgcggccagatcgatccgcacacgctgttcgcggccgagccgcagccgtgcctgtcggaagaactcggcaacggccgtttcctgctgttccgtgtcggcgactgcatctcgatgcacaacgtccacggtgcgatctacgactcgctgcgtctcgtgaaggatttctaaaagatgaacccgtccttcctcattaccgccctgttgtggctgtcggtggcggggctcgcgttcgcggtcgcgaagcgttcgtcctactggcggctcggccgcgccacggcgcccggcgcgttcggtgtcgcgaacctgttcgcgatcccgaagcgttatttcgtcgacctgcaccacgtggtcgcccgcgatccgtacatcgcgaagacccacgtcgcgacggccggcggcgcgatcggcgcgctcgcgctggtgttcatcaactacggcctcgcgatctactcgccgtggctcgacaagctgatcttcctcgcggcgctcgcgatgctggtcggtgcggtgttcgtgtggcgccggcgcgcggcgaaggacgtgcccgcacggttgtcgaaaggcccatggaatacgctgccctggctgctcggctcgttcgcgctcggcctcgtgctgttcatgctggtgccgaccggcgcgatgtcgggcgcgttcgcggtgctctgcgcgctgctgatcggcgtcggtgcattcacgatgacggtcggcgccgcgaagggcggcccgatgaagcatgcgatcgccggcctgctgcaccttgccttccacccgcgccaggagcgcttcgcggccacccgtgaatcgttcacgggcaacggcacggccacgccgccgaccgcgctgaagctgccggacatcgagcatcaggagtacggcgtcgagaagccggtcgaattccgctggaaccagctgctgagcttcgatgcgtgcgtgcagtgcggcaagtgcgaagccgcgtgccccgcgttcgcgtcgggccagccgctgaacccgaagaagctgatccaggatctcgtcgtcgggatggcgggcggcaccgatgcggcgtacgcgggcagtccttcgccgggcctcgcggtcggccagcatcgcggcgagccgaacggcccgatcgtgtcgggcctgatcgaggagcagacgctgtggtcgtgcacgacctgccgcgcatgcgtgcaggaatgcccgatgctgatcgagcacgtcgacgcgatcgtcgacatgcgccgcaaccgcacgctggtgcacggcacggtgcccggcaagggccaggaagtgctcgcgaacctgcgcgagacgggcacgatgggcggctacgacacggccgcgcgctacgactggtcggtcgacctgagcgcgcccgtcgcgcagcccggcaagccggtcgacgtgctgttcgtcgcgggtgagggcgcgttcgacatgcgctaccagcgcacgctgcgcgcgttcgtcaaggtgctgaacaaggcgggcgtcgactacgcagtgctcggctcgaccgagaccgacacgggcgacgtcgcacgccgcctcggcgacgaagcgacgttccagcagatggcgaagcgcctgatcggcacgctcggcacgctgtcgtacaagcagatcgtgacggccgacccgcacgtgatgcacagcctgcgcaacgaataccgcgcgctcgggctgcgcgtgacggtcaagcatcacacgacgtatctcgccgaactggccgacagcggcaagatcgcgccgaaggccgtcgaagcattgagcgagaagcgcaccacgtatcacgacccgtgctacctcggccgctacaacggcgagacggaagcgccgcgcaagctgctgaagacgatcggcatccaggtcgtcgagatggagcgcaacggcatgcgcggccgctgctgcggcggtggcggcggtgcgccgctgaccgacatccccggcaagcagcgcattcccgacatccgcatcgccgacgcgcgcacgatcggcgcggacgtggtcgcggttgcatgcccgaactgcacggcgatgctcgaaggcgtcgtgggcccgcgccccgacgtgctcgacgtggccgaactcgtcgccgcctcgctggagtgaatcgatgaacacgatcaaacgaatcgatccgcgccggccgttcgtcatcacggccgcgggcctgaagcgcatcacgctcggcgaggaaggcagcgccgatgcgagcgccgcgcactggtcggcgcacggtcacggcgcagcggccgcgaagccgcgccgcgcggtgcaggacccgaagcacgtgatgctggtggtggcgcacggtgagcgcggcgcgctcgacgatcattcgcggcaggcgatcgccgccgccgcattgctcgccgatgcgcagaccgaagtcgcgctgctcgcgttcggcgaactgaaggacgacgtggccgaactgggcgtcgacaagctgctcgagttgaccggcttcgatcgccgcacgttcgatcccgaaagcgaactgcaagcattgcaggcctgtgtggccgcgctcgcgccgaaacacgtgttcgtgcccgacaacgcgacgggcgacggcgatctcggccggcgctacgcggcggccgccggcgcgagcgtcgcgacccatgtcgtcgagatcgacgcgaagcatgtcggcgcgtatgcgcaggccgggcgcgcctttgcgacccgtgcgctgcccgacgtgatcctgctcgcgcagaacgcggtcgacgcgaagctgccgttcgtcggcgcgggcgagcgtctcgccgccgacttcatccacccggcccgtgacgccgcgcagccgtatcgcgatctcggcctcgatgaaatcgacgcggcccaggtcgcgctcgaggaagccgatttcatcgtgtcggccggcaacggcgtatccgacatcggcgcgttcgagcggctggccggcgtgttcggtgcggcgatcggcgcgagccgcgtcgcggtcgacaacggtcacttcacgcgcgacaagcaggtcggcgcgaccggcaagacggtcgaggcgagcgtgtacatcgcgttcggcatctcgggcgcggtgcagcacctgcaggggatcaaggactgtcgccacgtgatcgcggtgaacctcgacggcagcgcaccgatcgcgaaacgcgcgaacctgacggtggtgggcgatgcgcaggcgacgatcgccgcgctgatcgagcaggtgcaggccgcgcgcgccgcgcgtggagaatcgccggccgcggtcggcacccgtgaaccggaaggagtcgccgcatgaacgcccccgccccttgcaacgcatcgcggtgctcgtgtccgtcggccgtcatccggtcagcggcgtcgcgcgctacagccgcaacgacgcggccgcgctcgaaaccggccgccagctcgccgagcagcatcgcgcgaagctcgacgtgatccatgcgggcgatcccgcgaacgcggcgcttgccgaatatctcgcgctcggcgcacgggaggtcgaggtgctggcctgccgcgacggcgacgatgccgtgcatgcgctcgccgcgcgtatcgacggctacgacctcgtgctgaccggcacacgcgccgagggcgcgtacgacaccggcatgctgccgtatcgcatcgccgcggcgctcggctatccgctggtcggctcggccgtcgacgtgacggtcgaaggcggccgtgcggcggtccggcaattttgccgaaagggctgcggcgccgcgtggacgcggcactgccggccgtcgtcgccgttcacccgctcgcgaatgccgagccgcgttatgcgtatgcgcggctgcgcgccggcgcgatccggcccgcgctcgcggcgcccggcgcggacgccgacgcggccgcgtggacggtcggcccggtcgagcgtaaacccgtaaagctggtcgccgccgagaagcgctccgggcatgcccggatgctgtccgcgacgacgaccgaaagccgtggcggcaacgtcgtaaatgaagggagttcggtcgaaaagcacaagtgatcctcgcgtatttgcgcgagcatcagctcatcgactactgattttgatgcctgtcggcaagaacccagggatgcaaggaatccggagcaaacgatgaaagtatcggcagacattcgtgcattgatcgagcggcgcaaggaaggttacagcctcgaagcgccgttctacacgagcgaggacatcttcgcgctcgacatggaggcgattttccgccagcactggatccaggtggcggtcgagccggacattcccgagccgggcgactacgtgaccgtggaactgggcagcgattcgatcctgatcgtgcgtgacgacgacatggcgatccgcgcgttccacaacgtgtgccgtcaccgcggcgcgcgcctgtgcaacgaggacaagggctcggtcggcaacatcgtgtgcccgtaccacagctggacctacaacctgacgggccagctgatgttcgccgagcacatgggcgagaagttcgaccgctgcaagcacagcctgaagtcggtccacgtcgagaacctcgccggcctgatcttcatctgcctcgccgaggagccgccggtcgatttcgcgcagctgcgcgccgagatggagccgtacctgctgccgcacgacctgccgaacacgaagatcgccgcgcagatcgacatcatcgaggaaggcaactggaagctcacgatggagaacaaccgcgagtgctatcactgcgtcgcgaaccatccggagctcaccatctcgctgtacgaatacggtttcggctaccagcgttccgacgccaacgcggaaggcatggatgcgtttgcggaaacctgcgtgcggcgcggcaaggagtgggccgagatgggcctgccgtccgccgagatcgagaagctgctcgacgtgacgggtttccgcacgcagcgcctgccgctcgatcgccacggcgaatcgcagacgctcgatgcgaaggtcgcgtcgaagaagctgctcggcggcttcgacaaggccgacctcggcgggctgtcgttctggacgcagccgaactcgtggcaccacttcatgagcgatcacatcgtgacgttctcggtgatcccgctgtcggccggcaagacgctcgtgcgcacgaagtggctcgtgcacaaggacgcgaaggaaggcatcgactacgacgtgaagaacctcacggccgtgtggaacgccacgaacgaccaggatcgcgcgctcgtcgagttctcgcagcgcggcgcgaccagcagcgcgtacgagccgggcccgtattcgccgttcacggaaggtctcgtcgaaaaattctcggcctggtacatcggccggctcgccgaaaaaccggcgcgtagtacccagcactgaagcggagttacagatgatgcgagatgcggccaacttcgagccgacggacagccgggtcacacgcccggcgttctggagcgcccttcccgagcgctggacgagcgacgtcgaggaaacgctggtgtgctgccacgtgcggcaggaaacgcacgacgtgaagagtttcttcttccgttcgccgcagggccgctcgttctcgttcgagcccgggcagttcctcacgctcgaactcgacatcgacggcgaaacgatcaaccgctgctacacgatctcgtcgtcgcccgcgcggccgcacacggtgtcgatcacggtgaagcgcgtgccgggcggcaaggtgtcgaactggctgcacgacaacctgcagccgggcgcactggtgcgcgtgctcggcccggccggcgaattcacgtgcgcacgacatccggcgcgcaagtacctgttcctgtcggcgggctcgggcgtcacgccgctgatgtcgatgagccgcgcgcaccacgatctcgccgaggatcgcgacatcctgttcgtgcacagcgcacgcacgccggacgacatcatcttcgcgcgcgagctcgacctgatcgcgtcgaaccacacgaatttccgcacgtcgttcgtcgtcgagcgcgtcggcgcgcgcaccaactggccgggcgtcacgggcttcctgacgctgccgctgctgaagctgatcgcacctgatttcatggagcgcgagatcttcacgtgcggtcccgcgccgtacatgaaggccgtgcgcgacctgctcgacgaagccggcttcgatcgcaagcagtatcacgaggagagcttctcgttcgaaacgctcgcgcagaccgcaagcgacgagctgctcgccgatctcgccccgccggccgaaggcgccgacaccgatacgaagcagtacacggtcagcttcgcaaagagcaatcgcgagatttcatgcggctcggagcagcacgtgctggacgcggcgcgccagtccggcgtgcggctgccggcctcgtgcacgcagggcatgtgcggcacctgcaaggtgaagctcgtgtcggggcaggttgaaatgaagcacaacggcggcatccgccagcgcgagatcgaccaggggatggtgctgctgtgctgcagcaagccgctgtcggatctcgtgatcgacaagtagtcgaaactcgccatcggctgtccgggcgcgtcgcgtccggacaagcatccgtcggaaaacaacgataccgcggatttgtggttgaagaacctagagagacaacgcgcacggtgcgcatttcaaggagatcgaccatgaagctgttcggaaaactgatgtggaccggcgcactgtcggcgatggtggcactgagcgcatcggcgctcgccgatacgaagcccacgctgaagatcggctacgtcgaaggctgggacgacagcgttgcgacgtcgaacgtcgcggcgcgtgtgatcgagaagaaactcggctatgaggtgaagctcgtgccggtcgctgccggcatcatgtggcagggcgtggcgcgcggcgatctcgacgcgacgctgtccgcgtggctgcccgtcacgcacggttcctactggggcgagtacaagaccaaggtcgtcgacctcggcgcgaactttcccgacgcgaagatcggcctgatcgttcccgattacgtgaaggcgaagagcatcgacgacctgaatgccgaaaaaggcagcttcggcggccggatcgtcggcatcgatgcgggcgcgggcgtgatgcgcaagaccgacgaagcgatcaagaactacggcctgaactacacgctgatgccgagctcgggcagcgcgatgacggccgagctgtcgcgctcggtcggcgcgaacaagccggtgatcgtgaccggctgggcgccgcactggatgttcgcgaagtggaagctgcgcttcctcgaggatccgaagaaggtgttcggcggcgcggagcacgtcgacagtgtcgtgaacccgcagctcgaaacgaaggccaagccggtcgtcgcgttcctgaaaaattccagtggaagccgggcgagatcgacagcgtgatgctcgcgatccagaacggctcgaagccggaagcggctgccgatgcatggattgcagcgcatgcggatcgcgtgaattcgtggacggaaggcgtgcagtaagccgcgacgattcgccgcaataaatagacgaagagacagtccgggattgatcagcaggatagcgaaataattgcactgcgatgcgatcatatcccggaattatttttggttctgcaaaaagccggtaagttgttacactacggcccttgtgcggagtcatcacaggaggaattggatgagtcaggcaggactgcgtgcgaacagcaccagtgatgttgaggcaaccatctcacatgattcgacgggccacacgctgcatcgtggcctgacttggaaagacgcttttgggtaacgagcggcgtgccggcaggcgtgctgttcacgatcggcggcgtatgcgcgacgatcggccagcccgcgtgggcgatctggatcgccgcgatcacgatggggctgattcagagcgcgacttatgcggaaatatcggggctatttccccataaatcgggcggcgcgtccgcctacggcgcgatcggctgggtccgttacagcaagctgattgccccggtttccgtgtggtgcaactggctcgcgtggtcgccgatgctcgcgctcggctgcggcctcgcggcgagctatgcgctcacgagtctctttcccgccaacgcggcggtgctgcactggcagctcaaggttgcggatctcgggttcatcaagccgggtctgtccctgcggatcaatgcgacgttcatcatcgcgacgatcctgcttctcatcacgttcaagcttcaacacagcggtgcatcgaaggcggcgcgcacgcagcgcattctcggcatcgcgtcgctcacgccgctgttgatcgtcggcatcgtgccgttcgtcacgggcgacgtgccgatgtcgaacctgcttccgctgctgccgctcggtcacgacgcacacggcaatctcacgaccgcgacgttcggctcgtggaacgggcagggcgtcacgatggcgctcggcgcgatgttcatggccggctgggcgtcgtacggcttcgagacggccgtctgctacacgcgcgaattccgcgacccgcgccgcgataccgccaaggcgatcttctggtcgggcgcgctgtgcctcgtcgtgatgacgctcgtgccgatggcgttccaggggcgctcggcacgcaggcgatgctcgatccgtcgatcggcgacggcaccggcgtcgcggccgcgatggcgaagatcgtcggcggcggcgcgtgggtcgcgaatgcagtcgtcgtgatgctgatgctgtcgatcctgctaatcgtgatgacgtcgatgatgggctcgtcgcgcacgctgtaccaggcatcggtcgacggctggctgccgaagtacctgtcgcacgtgaacgagcacggctcgcccacgcgcgcgatgtggaccgatctcggcttcaacctcgtgttgctgatgatgtcggactacatgacggtgctgtcgatctcgaatgtctgctacatgctgttcgtattcctgaatcttcagtcgggctggatccaccggatggatcgcggcaactgggatcgaccgttccgctgcccgacgtggctgctcgtcgccggctcgatctgcggctacgcgaacctcgtctatgtcggcgcgggcgcgaacctgcagggcgaaggcacgctgcgcaacgggctgatcgcgatgctgctgatcgtgccggtattcctgttccgccattactggcaggatcgcggccggttccccacgcagatgcagcgcgacatggaactcgaggtgccgaagcgcgcgatgtggctcaacctgatgccgtatgcggcgctggtcggggcggggttgacgatctggttgtcgtattactttgcgtgggtgaagtgaacaggtggtgagcaaggcgactcttgcgccggacacggaaaccgcacacgggtccgacgcgagaggagcaagtgcactgcttgtgctttacgattgcccggcgcgcgtgcgtcaggcctgatcgaggtacgacacgagccgccacgcgacttgcgtggtctgttgacgcatgccgatcacgcgatcgagaagcggaagtgctcttgattcgtgcacgatgatcgaaggcagggtatcgcccttcaggaaccgccgttccgagtcgccggcctggccttccttcagcgccgcacaccagacgccgtcttcggggcagcgttccccgtgcgagcgaccgttccgatcggcagtcgagtcgcgagggttgccggttgcggttcagccgaagttttgtcctgcgcgccggcgagcggtaaccccgtcgccggatcgaggtgcttcgccttcgccatttcgttgatcatctcgtcagaaggcttttgcggaggcgcggcggcatcctgctcctttgccactggaaggtgccgtcccagggcgggagtttggccggcggcagagggacgatcttgtcgatatcgggaaccttggggttacggccgtcgttgcggtcgatgaattttccgatctgtgcgtagcgtcgtgtgcgttcgggatcgctggccaagtccaggtaatacagggcatcggacttaggcgggccttggaacgcgtgttcgagcaggaatgcactttgcgtgtctccggactcggcacctttctggaaggccttgagtgcttcctgatagaagccgtcggtcatcaagtcggcgccaagcatgttggctgctttgccgttgccttgggcagttgcgcactcccgcatctgcttcgcaatggccggtgcattgtcgcggagcgattcgccgatgtagtactgcgcatcggggttgcccaaatcggcagcctttcggaagtaacgcagcgacatctcgtagtcttgcttcaggccgtatccagtttcgagatagtggccgatattgtagtagccggcaggtatgccttgctcgaccagttttgaagcgagatcaaccacttctttcgccgggtcggggagtgggccagttcttgcgaaatcaggagttgagcgttgttgttcgccttgtagtgaccgtatgctgccgcgatccgatagtaacggacgatatcgtcgaagtctttcggtccgctccgcttctgcagatatcttccatactgaaacagttcatctgccttgggatcgagtgcagggagatggtctgcttcatgtgtgcaggtgaatgcgagattggcgtgcacgttgttgaggtcgggaagggggcgactgggacactgggttttcctttttcgtacatgcacccatgagaagggcgagtgaaatgcacaggacgaatctgttcatcgatcaatcatcgtaagtacggttatcggaaggtctctcgaacttgacgagcgaggcgataggcttcatccctttgttattcaacgttttgttgcggtccaggattgtgccccacgccttgaaggaacttgcatggtcgtccagatcccctgccccattggtgtgaagccccaaagcttccttcgcaacggcttcgtgacatcgctgttctcgtgacaaatattgagctcgctatcgacgttcatgcttcggatgttcacgttcgctgagcccagcgtcatgaatgcgtcgtcgaccgtcatcagtttggcatgaacgtataccggcaaccagttgtccgggtgcgagtcgggcgcgaccagcgtgcaaatatgtatcttaagccccggtacctccgtgggcggtgcatccgggtgaatgttcgcgttggcgcgtttcttccgctgtacttcgtccagggcgatctgaatgtcctgctgctgcgcctggctggcctgaaagtagttggcgacaccttgcatcgcggagccgtcaaacggatttactccttgagactgaattttctgcaacgatgcctgctctgccgagagctgtgacaagagggagttctgctgtgcggtgagctggtcgtcgacggctttctgctggcctgtcatgccgtcttcgcgttccagcaatgcgacgcccggcatcgagttgccgtatccaagcgaattcagcatctggtacgttcttacggtcccgttgccaaccgcggcgtcactggagttcgtgatcacgaacaggtaaatcggtccgtcctggccgatatcccggccccagcggagatgcgaagcagcgacgttcttgatcttcgtggcaagttcctgccagcggaaatactggttctggatgaaaatgtactgcgtcgcgttgttgaccgcctgcaggtacattttctcgatgtcgcgcttacctttctgagactgtgtgcgcagaacctgcgcccttaccttgagatcgtcggccgagtcggtgcggatcttctgcttcccgccctgtcccgcgcgcaacttcgtcagattctgccccgttgcatcgtcccacgcttcgcagaaattcttgttcagatcctccagtatcggacccgttactcgactcgatatgtcctgccacggaaaggggccgttgcggcccgtactgggggtcttgggatcgtagtggtggtcgtcggtatcccagtactggtcgagcatgttgtggcccatgacgaagccggtggccagttcaggatcctcgtaatcgatcaataccatcttctggtgatgtgtcggctctgagcccatgcccttggctgcgcctcgtttcatggtcgagttccagtcggacttcgagccatagttccagatcctgccgatgatttcggcacgctccgaaaagctgaaccccgggttgcgatttcgacgttggccatggcctcctttcgatgaaggaacttggtcggcgcgtccgataaagacgtgagcgactgggcgacctttaccgggaacatgaccacgtcatcgaccacgcgattggcgatcgatgccgatccgctcctcgtaacattgctcagattggcgcgtcggtaccattccgtatcgaacttgcgttcgtcggccgtctggtaatcaggtgccatcagtggatggctgtcgtacgtatcctggctgatgctttgcttcagtttcgtaatgccatcgaagcccggcatgttgttttcactcagttcagccaggtaaaagtcatcgtgccagcacagcaatcgcactttgaggccttccttgccctttttctcgagtagttcccgatccgcatgccggaaccgtcacggcgaaaatacatggagggctggaagccccagcaaatgatgtcgatcgaatgcttggcgcttgcgatggcgtcgtataccgcccgaaacgcggtttcgccgttgaccaatggcctgaacgatccggacttggggccgtattcagtgttctgcacataccagggaaggcagacgttcgcggccgacgtctggttctgcgcgatgggcgtggtgatcttctggttcggtgtcgccatggcctatgcatccgatgaagggttgagcaggtcgctgtaaagttgccggtgtgtggcgcgatcgagggcggcggtgtcgccatcgggaagcgtttcgtgaaactggaaaccctgattcgcgagcgctccatttgccgcgtcccggtattcgcccgggaccggaatgtcgtgcgtgacgccgttggccatctccagcgtgtatttctgcgtggtgacgtgatgatcgatcggcaactggccggtgcggtccagtacgccctgcttgaccagggcgccatccgcatagagcttgtacggcatgcctgccggcaccacgccggtggctgatggcgatgccatcgtattcaacgtcaggcgtcgcgtcggcagatccttgaatgccggattcgtcacgtccattcgggttgggccgctgaaagtgaaatcggcacccttgaaatcgagcttgcccggcgcgtgaatctcgatgttgccgtccttgacccggatgtatgcgccgcccgatgtcagcagaatttcctgttgcgctgaggcctgtaccttttccgttgccgaagcgagtagcagggacttttgcgccgttacctcgacattgtctgcatgtgcctgcaattggatcttgcccttcgcggcgaacagcttcatgccggcgttctgcacaaacaggcttagcttctcggtgatgctggcgaccagcgatcgccccgctgcgatgtgcgtgctctggccgctgacgaggttgacatgctgatccgccgagacatgtgccgacttctgcgtagacaatgcgatgccggccggtgcggcgaccagaatcaccggctgtttgaatacgctggcctgtcccgttccgccgccggccgttacgccgcctccgcctgtcgcccccgtctcgttgtgggcggtcgcatccgcgaaggcgtgcaatgccgtatgcccgtctttctggctttccgcgcctgccgtttcgctggcttgcgagaggccgtcgagcacgttggcggaactcgtcaactggttggtggctacacgcgcatcgagcggttggctggccaccggatgagtcgatacgtagagtcctcggcccgaacgcaacgcgccatatgcgtcggagctgagatcgaaaccgctgccgagatagtcaccgcgagcgttgccggtgtggctgatcaggtaaccgaggtgcaattgagcattggtattgctgctgtatagctgcacacggttctgtccggttgagtcgtccatcaccatctgattgaagccggttccggaaaactcgcgggaccggtaacccgacagcaggccgttcgagtgccattgcggcttggttgcgccgttatagacgcgaagcagcgcgatgggccgatcgatatcgttgccgatatggccgatgagcagttcttcgccggcgcgtggcatatgcacgccgccgtagccgtccccggcatccgactgggcgacgcgcacccagcacgatgcgcgttcgtcgccgacgttgtgccgatcccacgtgaaaagaaccttgatccggttcagatcgtcggtatatgcctcctggccattcgggccgaccacgatggccgattccagtttggcctcgggcttgatgtgttcgaacgggctccgatatgggactgtggtgcgctgtgcttcaagcgagacgcgaaaaaccggtcgaaccatcggcgtgcgggaccgtgaaccggccgtcgtgatcgtcgtcgcgtgcgtttttcagcacgtgatgcaggctgtgcgggaagttggtctcatatttcgagagcagcagattgttgacgatggcccattcgacgtcgatcacggcgaattcccgttgggccgccggatccaggtcgtgctcggggtgtcccgtcatcgtgaagcgccgtccggcgtcggcacgacgcaagctcgcgacgccgtggaagcgcttggcttccgactcccattcctccatgcggagcctggacaaatgatcgccgcgatcctgcctcgggtaggtataagcgcccgtgtattcgtacacttccatctgtgcgggcagatcgccttgattggccatcgtcggaaccgacgtcgccttcggttggccggcgtcggcggattcttgtagtcgaaggtgcgtgtcgacagcagcacggactgcagcgtgcgtgtcgccgaccattgcgtgaaggtgtcggtgtggccatgggcgccggcgcgggaaaaggcgaccgtcgccggagacagcggttcgagcacttcgagacgatcggtgattaccagcgtatgcgatttgccgtcggccgcctgcttccagatcccgtatagcccttcggattccagaagccggtgtacgaagttccagtcggtttcatcctgtcggcagtacgaacgggacggcaatggctgcgccagttcgaatcgatacatgccgcgcgcttgcgggtgttgatccagcacgtcggcgatgatcgcatcggcgctcttgtcttgccagtgtcgctggtcgcgacggaatttcaggaaatgcatccaggacgagaaatgcaactgataggcagtcagtccccgttttcgcccagtcgccgggccgtgtggacatatccgtgatgcggaagataggactcgtcagtctgctgtatccagagcgtgaccggttgcgaaatcagcgtcttgagagggacgtcgtgcgagagcgatacgcaatcgaccatgaacaggtaatcgcgtccgatgcgcgaatgtccgatgacctggtgaggaatcagcacgtcagtgccgatcggcgtatccagtttgagaatacgtccctgctgggacaacgctcccgtcattgccccaatcatgcttcgcgcatccatgctatctctctcgttatttaggcgtatcgggcgattctacgcgcgatgaaattaaatctgaagagagtgggccggagactgatgaaaaggtgatgtggtttatcgatcttgcttggaattgtgtaaatatttctttgttgaatcaatgatgtagggggcgttggcgacgattttgcagattgatggaaatgcatctgaatgattgggaatacggtggtgtgcgtgcgattgaaggtgcttgcgaggttaatttaattgtaattatattgtttctttaatgtcagaattggctgatgggagttttgtagtcaaaccttcgtcggttaattgaaagagtgtgtgtttgcggtttcagggatttgttgcccgggcatagctgccgtccatattcggtgttctagcttgattttgggaatgatcggttctaatatccgtctccatgaacccgacctcgacacctcccggctcccgcgacaggggccgcccccgcgaattcgacaccaacgaggtgatcgacgcggcggcacgcgtgttctgggagcaggggtatcacgcgacgtcgatcgacgcgttgtgcgaggcgaccggcgtctttcgcggcagcctgtaccgcaccttcggcgacaagcacgggttgctggtcgccgcgttcgaccgttatgcggaaggtgcgatcgcacggctcaaggagcgtctcgcggcggatctgccgccacggcaggcactcagggcggcgctcctgtactacacggaaatcggtgcgcgcctgtcggagcggcgcggctgcttcatcacgaattcggccgtcgaactcctgcccggtgacgacgcgctgcgcccgtacatcgaatcgaccctgctgcgcattggcacgcaattcagcctggccgtcgcgcgaggccagcagtcgggcgatttcgaccggaatctcgatccggaggaggtgggccggttcctgttgtgcctgatccagggcatgcgcgtgttgggcaagtcgagtgcatcggaatcggaactggcctcgatcgtcgaaatcgcgatgcgggcgctgacctgatttttttggttattttgagaatgaatggtttcaaatgcgacgcataccgagggcccgcatcgagaccgtgaagggcaagcaaaagggtaacgaacgcgatacgacactgccgctgcgcgtagccgtatccgcatcatttttcaaccaatttaggaatgatcggtcatgaatgaagcaacactcgcaatgcccgccgcgaacgcgtacgggaaaggcgtcgtcgcatgtgtgaccgcaacgatcctgatgggcgtgatgtttccggtgatgaccgatgcgttgcggtacatcgatccctttacgttcacgtcgctgcgctacctgatcgccgggatgtgcttcctcgcattgctgcggatcgtcgaagggcccggtgcgtttcgttccgccggagaacccgtggcgctcgcatggctgctcggatcggtcggcttctgcggattcgggtcgttcgtgttcctggggcagcagttggccggcgacgagggcgcgctgaccgcatcgatcatgatggccacgcagccgatgatgggtctgctgctcaacgcgctggtgcggcgcgtcgcgccggcgccggtgtcggtgctgttcgtcgtgctgtcctttaccggcgtcgcgctcgtcatcacgcgcggcgacgtgatcgccgcactgcacgaaccgcagcactacgcggccaacgcgctgatcgtcgtcggcgcgctgtgctgggtcgtctatacgttcggcgcagcgcggtttacgaaatggtcggcactgaaatacacgaccttcacgacgtggcttgactgaccacgatcgtcgcagtcaacctggcgctgatcgcgacgcaccggatcgcggcaccgtcactcgccgcggtgcatgcggtgctgccgcatctcgcgtacatggggccggtggccggtttcggcgcgatcctgctgtggatgacgggcaaccggaacctggggccgatgaacggcgtgctgttcatggacatcgtgcccatcacggcattcatcgtatccgcggtcacgggcgtcgtgccgaaccgcgcgcagatcctgggcgccgcgctgacgggcgtggcgctgatcctcaacaacctctatctgcgacaccgggcgcgacgaatcggcacgacgcgtgcgcgcgtgccgtcggcttccgcgtgacggacggcgaagcccgcccgcttacgaaaacaccaccgtccggtcgccgttcaggaacaccctgcgctcgatgaacgcctttaccgcacgcgcgagcgtgatgcattcgacgtcgcgccccaccgcgagcaactgctccggccgcagcgcatgatcgacgcgctcgacgacctgctcgatgatcgggccttcgtcgagatcgtcggtgacgaagtgcgcggtcgcgccgatcagcttcacgccgcgggcatgcgcctggtgatacggcttcgcgcccttgaaaccgggcaggaacgaatgatggatgttgatcgcgcggttcgcgagcttcgcgctcgtttcctgcgacagcacctgcatgtagcgcgcgaggatcacgagttcggcgccgctcgactcgaagaagtcgagccattgcgcttcctgctgcgccttcgtatcggcggtgatcgggaaatggcggaacggcaggccgtgttgcgcggcgagcggctcgaagtcgggatggttcgacacgatgccgacgatatccatcttcagctcgcccatccgccagcggaacagcaggtccgcgaggcagtgctcgagcttcgacaccatgatcagcaccttcggccgcgcattcacgtcgtgaatcgcccattgcgtgtcgccttcgccgccaccgccgagcgcggtcgcgatcggcccgaattcctggcgcagcgcgtcgatctgcagcgtttcatcggtcggatgaaacacgcagcgcacgaagaagtgattgctgagatcgtcgtcgaacacgttcagcgcatcgacgtagcagcgatggcgctcgagaaagccgacgacggcggcgacctggccggccgcgctcgggcacgacagcgtcaggacgaattgatcggggcgtgagtcggcggtcatgagattcctcggatgtcatggaacgcaaccgcgcggcggcgcgacggggcgccacgctacgcgggtagcgggaggctcaagtaaatcaggacgattcgggcgcggatagaaccaacccgccgtgtggctggtatcggcacgccagcgcggtcgggcggcggcggggcttcaggcgggcgccggggaggcgtcgggcggggcgggcgcggccggtccagcgggcgtcgggcgcgcgtcaggcccgtagccggaggccggccggaaggccgttcaggccggtgcgcacgcgtcgagcagccagcgccggaacacgtgggtcgcgtccggctcgggcgctgcggcggccgtacgaggaagtagccgcgcgacgtgacgaccggcgcgtcgacgagcttcacgagctgcccggacgcgacgagttcgtcgacgagcggcgcccagccgagcgcaacgccttcgccgagcagcgccgcatggatcacgagcgcatagctgttgaaggtcacgccgcgcgcggcggctgccgtgtcgaggccgtgcgcgtcgaaccagccggaccacgacagccagcgctcggggcgcgtcggctgcacgtgcagcagcggcaacgcgagcaggtggtcggcccgggcgacgtgcgggtgcgcgtcgcggaacgggggcgagcacacgggcgtgaccgattccggaaagagccgcgcggccgtgcacgacggccagtggccgtcgccgaacaggatcgcgatgtcgccgtggtcgcgctgcgcgtcgtaatcctgcgacgtgacgacccgcacgtcgacatccggcatcacgcgcttcagcccggccaggcgcggcatcaaccagtaggtggcgaagccgaagtcggtgacgatcgtgagcgcgccgtgctcgcggcgcgcccgcagtgtcgcggtggcgccgcgcagcgtgtcgaggctcagccgcaccgcttcgtacaggcactcgccgtcggccgtcagcgtgacgccgcgcgggctgcgctcgaacagcggcacgcccagttcggcctcgagctggaacacctgctggctcacggccggctgggtggagccgagctcgcgcgcggcggccgtgaagctcgcgagccgggcagccgattcgaacgcgcgcagcgcctgcatcgacggtaacggttcggatttcgacataagtccctctaatggccccataagggccggacgccttcccgcgcgaattcgggcgggcgatagtgcatcggacggtgcggcacacgtgcttcacgggctgcttcaaaggctgcttcacggcccgctgcacattccgctccacggtggggcacgcaacgcattccgcgattctagccagcgcggcgtgcccgcgcggcactttcgtcgggccgcttccgtcataccggacgtctcgctgcgcgagcggcgcgccgatccattcgaacaccgttttcccacgactgccgatgacgaacccgacacccaacatcctgatcctgatggccgaccagctcacgccgttcgcgctgccggcctacggcaatcgcgtcgcgcgcacgccgacgctggaccgtctcgccgcgcaaggcgtggtgttcgacgccgcctattgcgcgagcccgctgtgcgcgccgtcgcgcttttcgctgctgaccggcaagctgccgtcggggatcggcgcctacgataacgccgccgaattgccggcgcaaacgctgacgttcgcgcactatctgcgcgcgggcggctaccggacgatgctgtccggcaagatgcacttctgcgggcccgaccagctgcacggcttcgaggagcggctcacgaccgacatctatccggccgatttcggctgggtgcccgactgggacagcccggcggagcggccaagctggtatcacaacatgagttcggtactcgacgcgggcccgtgcgtgcgcaccaaccagctcgatttcgacgacgaggtcacgttcgccgcgaagcagaagctgtacgacgtcgcgcgcgagcgggcggccgggcacgatgcgcggccgttctgcatggtcgtgtcgctgacccatccgcacgacccgtatgcgatcacgcgcgaatactgggatctctatcgcgacgacgagatcgacctgccggccgtgcgcctcgacgcggcggaaagcgacccgcattcgcagcggctgcgcttcgtctgcgagaacgaccgcacgccgcccaccgacgagcagatccgcgccgcacgtcgcgcgtactacggtgcaacctcttatgtcgacacgcagttcggcagcgtgctggccgcgctcgaacagtgcggattcgccgacgacacgatcgtgatcgtcacgtccgaccacggcgacatgctcggcgaacgcgggctctggtacaagatgacgttcttcgagggcggttgccgcgtgccgctgatcgtgcatgcgccgggccgcttcggcgccgcgcgcgtgcgcgggccggtgtcgcacgtcgacctgctgccgacgctcgtcgacctggccggcgccgcccccgccggcggctggccggaccccgtcgacggtgcaagcctcgtgccgcacctgaacggcacgccggcgcacgaagttgcgctcggcgaatacctcgcggaaggtgcggtcgcgccggtcgtgatgatccgcagcggcgactggaagtacgtgcattgcccggccgatcccgaccagctctatcacctcggcgacgacccgcgcgagctgacgaacctcgccggcacgccggaagccgcggacgtgctggccgcgttccgtgcgcaagccgcgcagcgctggaacctgcccgaactggaccggcaggtgcgcgcgagccagcggcgccggcgcttccattacgcggcgacgacgcagggccgcatccacgcgtgggactggcagccgttcaccgacgcgagccagcgctacatgcgcaatcacatcgaactcgacacgctcgaggcgatggcgcgctttccgcgcatcgggcgttgaacggaccacatcgcgatcattgaagaacgacggaggaagcgaaccatgaaacggcaacgcaatgcagcaatccgaaggatcggcgcggcgctcgccgccgccgcgtgcgtggcggcgacgcagcctgcgcacgcggccgacccgcagacgtgcggcgacgtgaagatggcggcgcccggctggaccgacatcgatgcgacgaacgcgatggcgggcgtcgtgctgaaggcgctcggctatcggcaggacgtggcgaacctgtcggtgccgatcacgtaccaggggctcaagaaagggcaggtcgacgtgttcctcggcaactggatgcccgcgcaggcgccgctcgtgaagccgttcgtcgacgagaagtcgatcgacgtgctgcacgcgaacctgagcggcgcgaagttcacgctcgcggtgcccgactacgtggccgccgcgggcgtgcatacgttcgccgatctcgcgcgctacgccgaccgctttggcggcaagatctacgggatcgagcccggcgcgcccgcgaaccagaacatcaagcggctgctgtccgaccatgcgctcgggtccgcgaactggtcgctcgtcgaatcgagcgagacgggcatgctcacgcaggtcgagcgcgcggtgcgcgacaagcggtggatcgtgttcctggcctgggagccgcatctgatgaacacgaagttccacctgacctacctgtcgggcggcgatgcgtatttcggcccgaactacggcggcgcgacggtcaatacggtcacgcgcgccgggttcgctggccagtgcgcgaacctggcgcggctgttccggcagatgacgttctccgtcgacgtcgagaaccggatgatcgccgacatgctcgaccacaagacgtcgcccgcgctcgcggcgcagcgtgcgctgaaatccgacccggcgctggttgccggctggctggacggcgtgacgacggcggccggcgctccggcctgccggcggtgcgcgcggccctcgacgggcactgattccctccttccgggcggccggtttcgaccgcgccgcccgtctacgtgttttcccgagcgggtcgcatcgtgaccatttgttgtcgccttcagacgggtgacgcgaaatatgggtttgtatttttcgccaatggctgcgttattgcggaaaacgaaatgccgaagccagcgggcgtaccgaattcgaatccaccggcgcatcgcagcacgcgccgggacgagattctttccatcgaacggttcaggagggtggtcgacaatgaagcacaccaaagttgccgtagccgccgcgcttgcatgcgcggcctgcgtgcccgccatcgggcatgcgcagagcagtgtgacgctgtacgggattctcgacgcgggcatcacgtacgtgaacaacacgggcggctcgcacgtggtcaagttcgacgacggcgtcgcgtacggaaaccgtttcggcctgaagggcacggaagacctcggcggcggcctgaaggccgtgttcaccctcgagagcggcttccgcctcggcaccgggcagctcggtttcggcggcgccgaattcggccggcaggcgtatgtcggcctgcagaacgactggggcacgctgtcgttcggcaaccagctcgacatcacgaacgaactcgtgtcgatctacaacatctccgcatggggcagcggttatgcgatccaccagggcgacttcgaccgcttcaacggcgaccgcctgccgaattcggtgaagttcctgtcgaacgacctcagcggcttcaagttcggcgcgatgtactcgttcggcaacgtcgcaggcaacttccaccgcaacagcgcatggagcgcgggcgcgagcttcacgaagggcgacttctcgatcggcgccgcgtacacgcgcctgaacaacccgaacggcatctatgcgttcgacccgtacgcgatgatcggcacgcacacgttcctcggccagcagaccgtcaccgtcgatccggcgaccggcgcacgcaccgacctgttcgcgaacacgccgatgaacgtcgacagccagggcacgttcggcatcggctcgagctacacgatcggcaagctgacgctcgacgccaacttctcgtacacgacgatcaagggtttcggccagtcgtcgcacatgcaggtgtatgaaggcggcggcctgtaccagttcacgccggcgctgagcctgatcgcgggttaccagcacacgcgcttcgaaggccatcactggaaccagggcacggcgggcctgcattacctgctgtcgaagcgtaccgacgtgtatatctccggcgattacctgcgcgcgtcgcaaggcgtcgatgcggtggtcggctacagcttcacgccgtcgacgacgcagacgcaggccgacgtgcggatcgggatgcgccattcgttctgagcggggtggtgtgaggttgtgacgtcttcagcgaggtctttggcgcgaaccgaggttcgcgcttttttgcccgactggggcgagcgggcacgagagccgtccggtcaaggcccgctgccggacgactgcccgacggtattgaccggtgccgtctatagacgctagcatcgtccccatgcttgatcgcgcccatttcctctcttcgctgctccgcgcatgttgtcagaacatgccagggaagttgcgtccagcgaactcgctgaacattcaagcaatcgccttccggccgcctgtgatgcaagacaggcggcctttttgtttttgggccgacaccttcggacggagaaactcgatgccgcttgcgctgtatgacacctggtcgcgtaccgtacgcccgttcacgccaatccgggccgggcaggtcggcatgtactgctgcggccccacggtctacgacgacgcccacatcggcaacctgagaacctacgtgttcgaggatctcctgcgccgcgtactggtgcgcaacggatacgaggtgcggcacgtcgtcaacatcaccgacgtcggccacctgacttcggatgcggacgaaggcgaagacaagatggaaagggcagccgccggaccggcgaatcggcgtgggccatcgcccggcgctacaccgacgcattcgtgcgggactggcgcgcgctccacctgctcgagccgacggtctggtgccgcgccacggatcacatcgccgaacagatcgcgttcatcgatacgctcgaccggggcggctacgtctatcgtacggacgacggcctctacttcgacaccagtcggcaggatgactacggttatctcgcgcggctcgaccgcgcggggttgcaggcgggcaagcgggtcgcgctgggcgacaagcggagcatcacggattttgcgttgtggaagttcagcccggccggcgtcaagcggcagatggaatgggacagcccgtggggcgcggctttccgggctggcatatcgaatgctcggcgatgtcggcgaagtatctcgggacgttgttcgatatccattgcggcggcgaggatcatatcgccgtgcatcacagcaacgagatcgcgcagacgcgggcggcccacggcacgaacctcgcgaattactggatgcacgggcacttcctgacgctcgacgccgatacgaagatgtcgaagtcgagcggcgatttcgttcgtctgcagaccgtgcagagccggaatatcgacccgctcgcgtaccgttacctgtgcctgacggcccattaccggagcaagctgcatttcacgtgggcgtcgctcgatgccgctcacaccgcgctgaaccggcttcggcacctgtatgccggatggccggatggagggcacgtcgatgcggatttcgccgcgcgattcgacgccgaagtgaacgaggacctgaatctgcccagggcgctcgcggtgctctgggatctggtcaggagcaacctgccacccgcgacgctgaaagcgaccgtggacagcttcgacgccgtgctgggcctcggtctgcgcgcatggaggccggttgcgcccgacattccggaacacgttcgcgggttgctcgccgaacgcgagcgcgcgagagcggacaaggactgggtgcaggccgaccggatacgggaagcgttgagcgcgcagggttggcgagtcgaggacaccccggaaggtcaacgcctgttcggcatcgccggcggcgcgaccgatgagggcgttccgccccgctgaagcctgcggccgcctgcatcggaagatcccgtgcccgagccgccatccggcggccgcgatcgacgcggccgccggatgcgtcgccccgagtccgcgcgatgttgccggccacgtccccggcccgttttgcgcgcttggcatatcatcgcgatttcgccgcgtccgtaccgttgtcgcgcgcatgcatcggcgtgcgcagtcgctttcccgaacggtgccggcgtgccgcgccgaccgccgagacctcgatgaccgactccgtgcccgatcccagtcctttatccccgttgcccgccaacctgttccgtcacgcaccgttccagcgcttctggggcacgcgcgtgatgtcttcctggctttccagatcctgtcggttgcaatcgggtggtacgtctacgcgctcacgcacagcgcgttcgcactcggcctcgtcggcctcgcgcagttcgtgccgatgttcgcgctgacgctcgtcgtcgggcaggtggccgaccgctacgaccgccggcgcatcgcgacgatctgccaggccgtcgaggcgctggccgccggcgtgttcctgctcggtgctgcgcagggtggctggccgcgccggccgtgtatgcgctcgcggcgatcgtcggcacggctcgcgcgttcgagtcgccgtcggtgtcgtcgctgctgccggccgtcgtgccgcgcagcgacctgccgcgcgcgaccgcgttgtcgacctcggcgaaccaggccgcgcagattctcgggcccgcgttcggcgggctgctgtatggcgtcggcgcgcccgtcgcgttcggcacgagcgtcgtcgcgttcgcggtcgcggcggtgttgagcggcacgattccgctgcgcagcgcgccgcccgcgcgcgaaccggtgacgctccgttcggtgttttcaggcatcgcattcatccggcgcgaaccggcgatcctcggcgcgctgtcgctcgacctgttcgcggtgctgttcggcggcgcgaccgcgctgctgccgatctacgcgcgcgacatcctgcaggtcgggccatgggggctcggcgcgttgcgcgcggcgccggcggtcggcgcgctcgcgggcacgctgtggctcacgcgctttccgctcaagggccggcccggccgtgcgatgttcggcggcgtgatcgcgttcggcatcgcgacgatcgtgttcgggctgtcgaggaatttcgtgttgtcgctcgtcgcgctggcggcgctcggcgcatcggacgtggtgagcgtcgtcgtgcgcctgtcgctcgtgcagctgcgcacgcccgacgacatgctcggccgtgtcagtgccgtcaactcgctgttcatcggcacgtcgaatcaactcggcgaattcgaatcgggtgtgacggccgcatggtggggcgcgccggccgcgatcgtcgtcggcggcgcggcgacgatcgccgttgcactcacgtggatgcggctgttcccgcagctcgcgaccatgaagtcgctcgagcgcgacgcatgacggacgtcacgcgtcctgcgtcacgcgcacggccgtgccgtagcagaggacttccgtgacacccgagccgatctcggtcgagtcgtagcgcatcgcgacgatcgcgttcgcgccgagcttgcgggcgtcggcgagcatcttgtcgaaggcctgctggcgggctttttcgcacagcgacgtgtagagcgtgatgttgccgccgaagatcgtctgcagcgatgcgccgaacgagccgacgatcgagcgcgagcgcacgacgatgccctgggcgacgccgagcgagcgaacggtcgtgtggccgggcaggtcgaacgcggtcgtgacccgggcgggcgacagatcgtcgatggagcgggagaaatcggtcatggcgggaagcgtgtagcgaagtggtcgaacggggattctatccggacgaagcggcgtacccggctcgacgacgggtcagcgccgcgaccgcggagaacgcttcgcgacggaagcgtgtgcaaaccgcgagcatacgcttccgtcatttccggacgaacagcccggctgcacgccgtcagggcttcacggtcgcactgccgttgccgccgagatcgaccgcataggccagcgccagcttgccgaacttcaatgcgtggttcgcctgccgatccgaattctccagcgtgtcgttcacggtatggatatacggactgtcgttctgatcggcctcgaacgggaacgacgccggatacccttgcgcattccacgacgcatgatccgagcacgcatacccgcactgcgacgtgccgatcgcgagttccggcaggtaggtcttcgccagattcgtcaggtaggtgttctgcgacgcgttcgtgtagtcggtgatcaggtagatgtccttcgggtcgcccttgtagttcgtcatgtcgagctgcagcacgccgaccacgttcgcgttttgcgcacgaaactgcttcgcgatcgccttcgagccgagcaggccggcttcctcggccgcgtacccgacgaacttgatcgtccgcttcggccggtagttgttcgccagcagcacgcgcagcgcttcggtgaggctggcgatgcccgacgcatcgtcgtccgcgccgggcgagcgcgtgttttccgtcgtgcgcccgaccgtcgaatcgaggtggccacccagcacgacggtgcccgcggtcggatcgctgccgcggatcgtcaggatcacggatttctgcggaaagcccgtatgcgcgaactgctcgacggtgatgtcggcgcgcgagccggccagctgcttccactgcagcgcgagccagtccgacgcggcgacgccgtgcgacgtcgtgtagtagcggttcgtgaagccggacagcgacgtgatcgtgccgacgatgttgctggcctgcagctgcaggatccacgtgccgatctgcggtgcgttcgaaaccttgtacgtggaagccgcggcctgcttcgcgagcggcgtcggcaacggctgcagtgcctggcgcgcgtcgtcgaacgagtcgtgcacgacatagccgggcccgtggccgcgcgtatggtggacggcgtgggccagttcgccgagccgcgaatcgtctatttcgacgacgtgtacggtctcgcggcgcgccgcgccgtcggccgccttgccggcgtcgagggtcgtgctgtattgcgcggtggcgcttgcgtcgatgcgttgcaactggcggaacgccgcgtcgccgagcgtgatccataccggcgtcgcgtgcgcggcggcggtcagcagcatggcgcccagcgcggcgctcaggcgggtgagtttcagagtaggcatgttcgatctcgtgaggatggcgatgtcgatgaaggagcgcgtcacaggtcgtgcgatgcgcccccgcctgctgcgggattacgacttcttcggtacggtcacgccgtacgtgcaactctggttgtacgcattgccgatcgcggtgagctgcgcgctgctgtagccgagcgcggacgcggccgtcagcaccgcctgcgcggcggccttctggttggtcgagccgttggtcatcgacagccccttcaggaacgccttgtccatcgcctgcgcaccgatcgcgtcgcgcgcgacgaggttgcacgaggcccagtactggccggccgtatggatctccgcgccgcgtgcctgcgcataggtgcgcccgacgttccagttggtcacgcggccgccccagaattcgttgtggccgtcccagttgtagacccagtggtactgcgcatccgacgggctccactggttgaagtcgcggctgtacgcggcggcgagatagtcgccggtgccttccgacaacccttcctgctgcgacaggccgccgttcgtcacccagtcgtggatgccgtggccgagttcgtggatcacgacgtccgcatcctccgcgtcgtcgacgccgccttgcccgaaggtcagccggccgctgctcgacgaatacgacgagttgtcgtcgcccgattcgccgtgcgggtcgtactgcacgccgcccgtgtactggtacggcagcgccttgatgccgagcgtctggttcacgtaacgcaggaacgtgtcgatgtggtagtacacgttcaccgcctcgaaatacaggttgccgcgcgtgaattcgaatgcgggggtcgactgcacggggcacgcgttgtcgcgcggcgcgtcgaaatcgacgcatgccgcatacgggcccgacaatgaataacgcgcacccgactgcgcgagatccttcagcgtcacgcgcacgcgcgcggcggtgagttgcgacgaatcgacgtcgttgctgtccttgtagcccgtgctgccgtagctgcttttggtcggcgacagcgggtcgggccggaacacgaaacccgtgccgtcggtcgcgtagaacgccttgtcctcggcgcgcagcacttcgccgctgcccgagtcgatcagcagttcccagtcgcctttcgggccgtcgttcgggcggccgcgcactttccacgcggtatgcgtgccggccttgtcgacgaaggcgacgagctgcgcatcctggttcgtgaagccgctcacgccgagatacgcgcgtgcgcggtcgagcgcctgctgctggtcgacggcctgcgccttgcccgacttcgcgaccacgccgttgatcgtgttgctcgcgacgtacaggatgcggccgtccttcgcgaccgtcaccgcgatttcgctgccgtacacgggcaatccggctgcctgctgctgcaggcgcacgacggtgaactcggcgtcgctgcgctccgacgtgacgacgaggctcgcgagcgcggtcgcgtcgagcccgagttgcgcggcctgcgacgcgacgaagtcgcgggcggtggcggcgggcgtcgcggcggccttcttcgcgcgataggcggggttgtacagcgtgacggcgacgccgtccgcgcggaactgcccggcggccgtatccgacctggcggccggcggcgcgacgccgcgtgtcaggctttcgcgcaggctcgttgcctgcggattcgagactttcgtatcggccgcggtgccgccgacgatgccgaaaccgagcgcgagacccagggcgagcggcagtgctttgcgtgatgtctgcatacgtgatcctcatctcaacggttggacacgcccgcgcgttcgtggcgcgcaggcacgacacggcccgcgcgccggctcgatggaggcggtgcggcgaagcggtgttgggagcgtcgactgactaaggaaacctaaatgtcaggtcgaaaagaaaccggcgggagtagcgggtgaaacggggaagaggcgcgcgcgaagcggcgaacgaagaatcgaacggcaggcaggtgcggcgacggcgaatcgagcatcgtcatgtcatacccctcggatcgaatcgatatcggcggcagcctgccgagatgcggcatgcatgtcgttaggctgcctatctaactttttggtatgttacagaatattttcaacgacattccagtttattttcgatgacctcttcagtccgtcgatcaatcgccggcattgttcagcgagcggcgggaaacgttgccgaaacgcgcaattccgtgctggattgtgcttgaaacctgtgacgatcagcgcgtcgcgcgacggtcgctgcgcgggctcaggccgaatcgcgcgcgatacgtgcgcgagaaatgcgacggcgattcgaacccgcacgcgacgcacaccgacgtgatgctcatgtcggtctgctgcagcagttcacgcgcgcgatcgagccgcaggttcaggtagaaatgcgtcggcgtgtcgttcagcgtcgcgctgaacagccgttcgagctggcgccgcgtgatcgacacctcctgcgcgagcgcatcggagccgagcgggttttccatgtgccgctgcatcgtgccgatcacctggatcagcttgcggttgtgcacgccgtagcgcgcggcgatctcgagccgctggctgtccgagcgctgccggatccggctgaccacgaactgctcggagatcgccgccgcgagatcggcaccgtgccgccgcccgatcaggtcgagcatcatgtcgatcgacgcggtgccgcccgcgcacgtgatgcgccggtcgtcgatctcgaacagctcctgcgtcgcgttcaggccggggtagcgttcccggaacgcggccagcgcttcccagtgcagcgtgagcggctgcgacgcgtcgaacagcccggcttccgcgagcacgaagctgcccgtgtcgatgccgccgagcgttgcaccatgacggtgctggcggcgcagccagtcgccgatcgcgcgcgtgtagcacacgagcggatcgaagccggcgacgacgaacaccgtatcgaccgtttcgacctccgcgcacgcggcttcggcggcgaccggaatgccgttgctcgcggcgacgggcgcgccgtcggcgctgatcacgtgccagcgatagagctccgtgcgaaagcggttcgcgacgcgcagcggttcgaccgcggacatgaagccgagcgcggaaaagccgggcagcagcaggaagtggaaatcctcgggcatcggggcaggcaatggaatccggtggtcgtcgcgtgtcgcgcggggcggggaacggtcagccggagattatcgcgggttttgcgcggcctcagcgcgttttgcgccgcgcgcggaacggcgcgcggtggtcgacggcaactcgccgaactgcgccttgtaggcgttcgcgaaatgcccgagatggatgaagccccagcgtgcggccgcgtcgctgatcggcaggtcggcctgccgcgtgtcgagcagcatccgccgcacttgcgacaggcgcagcgatcgcacgtaatgcaacgggctggtctgcacgaccgactggaaactgttctgcatcgtgcgccggctcacgcgcaattgcgtgcacaggctcagcacgtcgaccggtgcttcgggatggtcgatcacgtagtcgtgcacgcggcgcacgatgtcggcgcggcacgcatgcgtgagacggttcgacggctcgggaatccggtacgtgaggagatcgacgagcacgttgccgatagcgccgcgcagttcgcgctgcgcgcgtgcgtcgcggaaggtatcgggtgccgacaatacacgctcgaggtgcgtcgcgatctgcacgctcgcgcgcatcagcacggcggtgggcatgtcgacgacgccgcgccgcaacgtggcttcgtcgaggcggacgtcggccgcatcctcgatctgctgcatcagttcgccgttggcgacgacaccgatcagcgacatgtcgtcgggcgagtgcagctcgaacggggtgccgccgcgcgccagcaccatcgtgccgcgttcgatgcgcgtcccgccgaatgcgaacgcacccgagccggtgagcggcatgccgaacactgtctggtcgtgcggcaatcttccgcgctggatgatgcgaacgttggcggcttcctggaacagctgcacgctgtccagcaccgcatgcttgaccgcgctgcgatacgcgccggagccgatctggtcgtagcgctggttccagccgcgcagcgctcggcatgccggtccgcgttgtcgaacctctcgtgaaacacgaacacagcgcctccgggtgcgtcgatcaggaccgcgcaagattaaaccggccgcgcggtcggcgcaataaggggcagcgctattccgggcgtatctgccagagggtcggaagccttcggccggtgtgcctttcaggcggttttccaatatcccgaatcggcacgcacgcggtgccggtccgggtgctgaccggatttattgtcgaactacagtcgccccacgttacgtgattccccaactggaggcgacatgaggacaaggcgacgaaccgcggtgctcgcggcgacgctggcgttcgcggcggcatgggccggcagcgcgaatgcgacggaaaagccggaagaactggtggtgcagaagatgccgccctggcatccgcacgaggtctatatcgtcgacatctcgatgccgtcgatgaccgacggacgcatctacgtgtacgacgccgatgcgaagaagctgctcggccagatcgacggcggcttcggcccgggcctcgcgatctcgccggaccgcaagacgagcttcgtcgcgacgacgtacttctcgcgcggctcgcacggcgcgcgcaccgacgtcgtcgagatcaccgacaacacgacgctcgatcatgcgggcgagatcgtgattccggcgaagcatgcgcagcacgtgccgtcgccgtacaacaccgcgctcagcgcggacggcaagcggctgtacgtcgcgaacatcacgccggccgcatcggtgacggtgatcgacgcggtctcgaagaaggtgctgtcggagatcgacacggcggcctgcgtgctcgcgtatccgtcgggcaacgaccgcttcacggcgctgtgtgaaagcggcaaggcgctgaccgtcacgctcgacgcgaacggcaaggaaacgaggcgcacgatgtcggatgcgttcatcgacgtcgacaaggatccggcgttcgtgaacgcgtcgcgccacaagggcgactatctgtttacgacctacggcggcaacgtgcgcagcgcggatttcagcggcgacaagcccgtgttcggcaagccgtggccgctgctgacggacgccgagcgcgccgaaggctggcgcccgggcggcatgcagcagacggccgtgcaggcgaagcagaaccgctactacgtgctgatgcacaagggtaccgacggctcgcacaaggaccccggcacgcaggtgtgggtggtcgacctgaagtcgaagcagcgtgtcgcgcgctgggatctcgcgcagcagaagatcgatcccctcgtgtcgatccaggtcagcgaggacgacaagccgctgttctacgggctgacggcgacctccgacctcgtcgtgatggatgcgcgcacgggcaagcagcacgtcgagaagcagatcggcaatacgtcgtcgctgctcgtcaacccgtgaggccgcgatgacgctcgatcccgtacttgccaccagcgcgcaggccggcgctgccgtcgtcgtgctgctcggcgcctccgcgaagatgcgccggcccgccgcgttcagccaggcactcgccggctaccggctgctgcccgacgcgctgaccgcgcccgtcgcgttcgcgattccgctcgcggaagccgtcggcgcggcggcactgctgtttcccgatacgcgcacggccggcgcgatcggcctgatcgcgctgctcgtcgccttcgcggcggcaatcgcgatcaatctcctgcgcggccacaccgacattgactgcggctgttccggcttcgcggccgcgcgagcagatgcgccgcgcggcatcggctggctgcacgtcggccgcgcgctgctgctcgccgcgctggcggcgaccgcgctcgtcgagccgggcgcgcgcgcggtcgtgtggttcgactacctgacgctgttcttctccgtgctgctgatcgtctgcgcgctgctcaccgtcgacgtgctgctcgccaacgtgccgcgcctttcccacctgaggaattcatgatgcaaaccgctctcaccgtttccaccgccctgctgtgggtggccgtcctcgcgctcggcgcgatctgtctcgcgctcgtgcgccagatcggcatcctgtacgaacgcatcatgccggccggcgcattgatgatcgacaaggggccggcggtcggtgcgatcgcgccggcgttcgaactgaccgacattcgcggctcgcaggtgaaggtcggcggcatcgatgcgtcgggcaaggcgacgctgctgttcttcctgtcgccgacgtgccccgtctgcaagaagctgctgccgctgctgccgtcgctgcaggcgagcgaatcgacgccggtgaacatcgtgctcgcgagcgacggcgatatcgacgaacacacgcgcttcgcgcgcaagcacgacctcgggcgtttcccgtacgtgctgtcgcaggagctcggcctcgcgtaccagatcggcaagctgccgtatgcggtgctgctcgacgaaaccggcacggtgcgtgcgaagggcctcgtcaatacgcgcgagcatctcgagagcctgttcgaagcgaaggagcgcggcgtcgcatcgctgcagcagttcgtgcacggcgatcacagccacgacgcgcacgcgcagcacgcatgaccggccgaccctctttcaacgtcaagggagaacaacgacatgggcctgtttgattcatggttcgagcggtcggcgcgcggcgtcgcgcagcacagttcgcggcgcagcgcgatggcgaagctcggcaaggtgctggtgggatcggcgatgctgccgctgctgcccgtcgatcgcaccgcgtatgcggccgacgcggcgtcgggcgcatccggtgccgccgcctcgggggcgagcgacgacccgatgagctgcgactactggaaatactgcgcgatcgacggctggctgtgcagttgctgcggcggcacgtcgagcagttgcccgccgggcacgacaccttcgccgatcacgtggatcggcacctgccgcaatccgcacgacggttcggactacatcgtgtcgtacaacgattgctgcggcaagacgtcgtgcggcaagtgcttctgcaaccgcaacgagcgcgagaagccgctgtacaagctgtcgctgaacaacgacatcaactggtgcatggcgaacggcaattcgaattaccactgttcggtttcggttctgttgggggcggcgaagcaatgaaagtgaagcaagcaggaaagatcgcagtcgcgtgcatgacggccgtggcggccttcgcattgccaggcgccgccggcgcgcaggacgccgtgcattacccggccggcaagagcctgttcgacgcgcagtgcgcggtgtgccaccaggcgggcgggaaagggcaggacggcctcgcgccgccgctgaccgagtatccgggcaagtatgcgacggccgaggcggggcgtgcgcagctggtcgcgacactgctgcacgggatgttcggcgagatcaaggtgcacgacaagagttacaacttcaagatgccgtcgtttgcgagcgccagcgacgacgacatcgcgcacgtgctcaattacgtcgtgttcgatctcaacgcgcagcacggcgatgcgaagccgttcacggcggccgacatccgcgcggcgcgcgcgaaggcgatggacggcacggccgttcatgcgcaacgcgacgtcgtcatcaaggggctcggcctgtgaaggttgcccgtgcatcccgcgtttgcgacgtcgcgccgcgcgcgcggtgcgcggcggcatcgtggttcggcaacctgtcgcgccacctgtcgtcgctgctgatgcttgccggggcggtcgtcggcctgaccgcggcacccgcgcatgcggaaggcacggccgacgcggcgctcgcgcggcagcactgggtgctcaactgcatgggctgccacacggccacgggcggcggtatcgccggcaaggtgccgccgctcgcgaactcgctcggctatttcacgcatctgccggccgggcgcgagtacgtgatgcgcgtgcccggcgcatcgaactcagcactgtcggaccaggacctggccgacgtgctcaactgggtactcacgaccatgaaccgcgacgcgctgccgcgcgacttcaagccctatacggccgccgaagtcgccgcgcaccgccgtcctgcctattcagacgtcgcgaccgtgcgcgccggcctcgtccgcgcgttgcaggcacgcggggtcgacggcgtcgtggatcgctactgaccgacccattcaggaaatcgaggaagaacgaagatggagacaaaccagaactttccgctgctcgacgccacgcgcgcgtttctcgcgaagccgaagaagatgctgatcggcgccgagtggagcgacgccgcgtcgggccgccggctcgacgtcgtgaatccggccgacggcaccgtgctcgcgcgtgtgcccgaagcggacgagcacgacgtgcgacgggccgtcgcggccgcgcggcgcgcattcgatgcggggccgtggcgcaccgcgaagaccaccgaccgcgagcgtctgctgctggcgctcgccgacctgatcgaagcgaatgcgcgcgagctggccgagatcgagtcgctcgacaacggcaagcccgtgatggtggcgcaggggctcgatgtcgcgatggccgcgcagtgtttccgctacatggccggctgggcgacgaagatcgaaggcagcgtgatcgacgcgggcatgccgtacatgcccgacagcgagatcttcacctacacgcgcaaggagccggtcggtgtggtcggcgcgatcattccgtggaatttcccgctgctgatggcggcgtggaaactcgcgcccgcgctggccacgggctgcaccgtggtgttgaaacccgcggaagatacgccgctgagtgcgttgcgcctcggcgagctgatccaggcggccggttttccggacggcgtcgtcaatatcgtcaccggctacggtcatacggccggcgccgcgctgtcgcgcgatccacgcatcgacaagatcgcgttcacgggctcgacgcagacaggcaagacgatcggccacgcggcgctcgacaacatgacgcggatgtcgctggaactcggcggcaagtcgccggtgatcgtgctgcccgacgtcgatccggacaaggccgcactcggtgtggcgaacgcgatcttcttcaaccaggggcaggtgtgcacggccgggtcgcgcgcgtacatccacgcgaaggtgttcgacgacgtgatcgggcgtgtcgcgaagatcgccgcgagcctgaagatcggcccggggatggatccgtcgacgcagatcggcccgctcgtctcggcgaagcagcgcgagcgcgtgtgcggctatatcgattcgggattcggcgagggcgcgcgcgcgcggcgggcggccgagcgatcgagggcccgggcttcttcgtcgagccgaccgtgctggtcgatacgacgcaggcgatgcgcgtcgtgcgcgaggagatcttcgggccggtgctcgtcgcgatgccgttcgacgacgtcgacacggccgtgcagctcgccaacgacacgccgtacggcctcggcgcgagcatctggtcgaacgacctttccgcgattcacaagctgatcccgcgcatcgccgccggaacggtgtgggtcaactgccactcgctgctcgacaacgcgatgccgttcggcgggatgaagcagtcgggtttcggccgcgaactcggtcgcgcggtgatcgaccagtacacggaaagcaagtcggtgatgatgaactacgcatgagcgtagcggcgggtgcgtgcgttgccgccacgtcggccgcgcacgcatgccgcaggcgggcccatccggatcgcggcatcgcggccggcgccggcggcgggctgctgccacgcgccgatcccgttcggcgcaggcgcgctcgacctgaagcatccgctcgatgcggcaccgggcggtgcgcaaggccagccggccgggtcgaagcacgacatccgagcgcacgcgcgaatgccacgaacgcatcacgcacgaaccagcaccacgccgagaatgagacacgccgcgccggccaggcggatcgggctggccgaatgctgctggatgccgagcacaccgaaatggtcgaacacgagcgcgccggtcatctgtccgacgacgatcagcgcgagcgtcgtcgcggcgcccagtcgcggcaccatcaggatcgcgatgccgacgaacaccgcgccgaagaatccgccggtccagctgaaccacgaccccgcatcggcgacggtgccgctcgggcgaggatgcggggacaggagcgcgacggcgagcatcgcggccaggccgacgaggtagctgaccgacccggcccaccacggcgagccgagctgcgcgcggaggttggcgttgagcacctgttgcaacgccacgctgatgccggcggcgacggccagcagatacgacaggagagtagtcacgaagagggcggctccggcgatgtggcccgtgacggcggttccggcacggcaggcttccattctgggaagcgcgacggtataacgcaaatatcaaatcgggcgcttatccatctcgtttcggcatgccatctctgaagcaaattcagtacttcctgaccgtggccgatctcggcggcttcacgccggccgcgagcgcgctccatgtcgcgcagtcggcgctgagccggcagatcggtcaactggaagacgaactggggttcccgctgttcgaccgggagccgagggcgtgcggctcacggcggccggcgcgatctatcgcgatcgcgtcgcgtcgattccggcgaccctggctgccgcggccgaggagggcgcacggttgtcgcgcggtgaagcgggcgtattgcggctcctgcattcgagcaccgttcccgtcggcagcctgatgccggtgctcgagcgtttcatgagcgcgtgcccggggcgcggatcgatctcgaccgcgcgtcgtccgaggatcaggtactggagatcgcgaacggcaacgccgatatcgggatcgttcgtgtgccggtgctgcgccgcgatccgcgcgtccgtttcgtcgagctcgcggccgagcgcttgtgcgtggcggtgccggccgatcacccgctggcgggccgccggcgcaccgcgatctcgcggctgcggcacgagccgttcgtatcggccgtgcatcgggagcggggcgggctggcgcgcgtcgtgatcgacctttgcctgaaacggggattcgtgcccgcgaccgcccggatcgtgtcgccgaagacgtcgatgctgaatctcgtcgcggccgggcagggcgtggcgatcgtgccggaacggatggcgagcctcggtatcgacggggtcgtcttcgtgccgatctcggatgacgacgcaaaatcggcgtgcgcgctggtgctgccggtcgagccgacggcgctggcggacgcgttcgtgcgcgtgatcgcagcgggaagcgcgcgggacgatgcctgacgggcaccccgtgcgtcatcccgccggacaaaaacgccaacccgtcgaaacgggctggcgtcgtgcttccggtatggcgacgatcagaactggttcatcgtgttgtccttgcctgccgccttcagcgctgcttcgccgctgaagtattccttgtggtcgtcgccgatgtccgagccggacatgttctggtgcttcacgcaggcgatgccctgacggatttccttgcgctgcacgccggccacgtagcccagcatgccctggtcgccgaagtattccttggccaggttgtcggtcgacagcgcggcggtgtggtacgtcggcagcgtgatcaggtggtggaagatacctgcttcgcgcgatgcgtccgcctggaacgtgcggatcttctcgtcggccagcgtggccagttccgtctcgtcgtactccacgctcatcagttgcgcacggtcgtatgccgacacgtccttgcctgccgccttcatcgcgtcgtacgcctgctgacggaagttcagcgtccagttgaacgacgggctgttgttgtacaccagcttcgcgttcgggatgaccttgcggatctcgctgaccatgccaccgatctgcgcgatatgcggtttttcggtttcgatccacagcaggtcggcgccgttctgcagcgacgtgatgcagtcgagcacgcagcgcgcttcgcccgtgccggcgcggaactggaacaggttgctcggcaggcgcttcggacgcagcagcttgccgtcgcgcttgatgaccacgtcaccgttgcccagctggtcggccgacagttcttcgcagtcgaggaacgcgttgtactggtcgcccaggtcgcccggcgtgttggtcacggcgatctgcttggtcaggccggcgcccagcgagtcggtacgggccacgatgatgccgtcgtccacgcccagttccaggaacgcgtagcggatcgcgcggatcttggccaggaagtcctcgtgcggcacggtgaccttgccgtcctggtggccgcactgcttctcgtcggacacctggttttcgatctggatacagcatgcgcccgcttcgatgaactgcttggccagcaggtacgtggcttccgcgttgccgaaaccggcgtcgatgtcggcgatgatcggcacgacgtgcgtgacgtggttgtcgatcttgtcctggatcgcggccttcgctgcagcgtccttggcggcatcgagttcgcggaacaggccgcccagttcacgggcgtcggcctggcgcaggaacgtgtagagctcgcgaatcagcgcgctgaccgaggtcttttcgtgcatcgactggtccggcagcgggccgaactcggagcgcagcgcggcgaccatccagccggacaggtacaggtagcggcgttcggtgctgttgaagtgcttcttgatggagatcatcttctgctggccgatgaagccgtgccagcaacccagcgactgcgtgtacttggacgggtcggcgtcgtaggcggccatgtcggcacgcatgatcttcgcggtgtacttggcgatgtccaggcccgtcttgaacttgttctgggcacgcatgcgggcggcgtactcggggctgatcgcattccacgcgctgccgtggttttccttcaaaccggcaactgccttgatgtcgtcttgatactgggccatgtcaatctcctgggagcaaagcgcgtttgagtaactggttgagcgtgcccgctgcgtctgtcgcagcgaactgcatgggataaatagtaacgccgctcgttgagttttggcgatgtcttatataagacataagacattattttctgttgtttttcaatgagttacgtttctgtttttgcgatgcaaaacaagttttcaagcggcgaaaacgcggcggcgcgggaaatcggcgtggattccgcaatacgaaacgcgctttcggctgctggaggccgggccagcttcacatgcgtccgtgacacccgttcgtcggtgcggcgtgcgcgtgccgcgccagaagccgcaccggcgctccgtttcgtcctggcggagcctcgagcggcgcgccgcatgtggacaagctgaattccccgcaatacgcgcaagaaccccgtccaacaagcctttcaagaaacctagtggtttccacccatagtcgcaaacagtcaagaacaggtcgccgccggtcttctcgcgaccaatatggctcgttacttttactcccacgatgcaggtcggcgcacaccccgcgcaccggctgccacgagtccaacagggaggaaccgaaccatgaagtcgacgaagattgccgcgcttgccgcggccgtgctggcgaccggcgcgttcacgcatgaggcatgggccgaaacggatgccgcgacctgccgcaccgtgcgtttcgcggatatcggctggaccgacatcacgtcgaccacggcgcttgcgtcgaccgtgttcgaggcgctcggctacaagccgaccacgacgatcgcgtcggtgccgatctcgttcgccggcctgaagagcaagcagctcgacgtgtcgctcggctactggtggcccgtgcagcagaagcagctccagccgttcctcgacagcaagtcgatcaacgtcgtcgaaccgccgaacctgtccggcgcgaaggcaacgctcgcggtgccgagctacgaataccaggccggcctgaagaccttcgaggacatcgcgaagcaccgtgcggaactcgacggcaagatctacgggatcgagccgggcagcagcgcgaacgcgacgatccagaagatgatcgacacgaaccagtacgggctcggcggcttcaagctcgtcgaatcgagcgaggccgggatgctggtgacggtcgagcgcgcgatccgcgagaagaagtgggtcgtgttcctcggctgggaaccgcatccgatgaacatccaactgagcatgaactacctgtccggcggcgacgcggcgttcgggccgaactacggcgaagcgcgcgtgtacacgctgacggcgcccgacttcatcgcgcgctgcccgaacgcgggcaagctcgtcacgaacctgcgcttctcgacgcagctcgagaaccagctgatgcagtcggtgatgaacaagacgaagccggccgaggccgcgaaggcgtacctgaagaagaacccgcaggtgctcgatccgtggctcgcgggcgtcaagacgttcgacggcaaggacgggctgccggccgtgaaggcgtatctcggcctgtgacggcccgcgcgcgcgcggcgcgccctgacgaaacacccgcaatgcgacacaacccgagtcaagcgaggcaaccagcatgaaccatgaagtcatcatcacctgcgccgtcaccggcgcgggcgatacggtcggcaagcatccggcgattccggtcacgccgaaggagatcgcggccgccgcgatcgaggccgcgaaggccggcgcgaccgttgcgcactgccacgtgcgcgatccgcagacggggcgcggcagccgcgacccgaacctgtaccgcgaagtggtcgaccggatccgctcggccgacgtcgacgtgatcatcaacctgacggccggcatgggcggcgatctcgagatcggcccgggcgaggacccgatgcgtttcggcaagggcaccgacctggtcggcggcctcacgcgcctcgcgcatgtcgaggagctgctgcccgaaatctgcacgctcgactgcggcacgctgaatttcggcgacggcgactacatctacgtgtcgacgcccgcgcaattgcgcgccggcgcgaagcgcatccaggaactcggcgtgaagccggagctggaaatcttcgacacgggccatctgtggttcgcgaagcagttgctgaaggaagggctgctcgacgatccgccgctgttccagctgtgcctcggcattccatggggcgcgccggccgatacgggcacgatgaaggcgatggtcgacaacctgccgccgggtgcgcactgggcgggcttcgggatcggccgcatgcagatgccgatggtcgcgcaggcgatgctgctcggcggccacgtgcgcgtcggcctcgaagacaacatctggctcgatcgcggcgtgcacgcgaccaacggcacgctcgtcgaacgcgcgcgagagatcgtcgaacggctcggcgcccgggtgctgacgccggccgaaggccgccgcaagctcggcttgcccgcacggggcgagcgtccgctcgaacgccgagcggtcgccgagttcgcgtgagcgattgcgctgactgaccgacatgacgcggcggcacgcccagcgcggccgcccaccgatttccctgatttgaaggatgcgttgacatggctgtgaagaccgacatcaagacgttcgccgccatcggcaccggcgtgatcggcagcggatggatttcccgcgcgctcgcgcacggtctcgacgtggtcgtctgggaccccgcgccgggcgcggaagaacggctgcgcgcgaacgtcgcgaacgcgtggcccgcactcgagcgcgtcggcctcgcgcccggcgccgatcccgcgcggctgcgtttcgtggcgacaatcgaagcgtgcgtcgccgatgccgatttcatccaggaaagcgcgcccgagcgcgaggcgctgaagctcgaactgcacgagcagatcagccgcgcggcgaaacccgacgcgatcatcgcgtcgtcgacgtccgggctgcttccgacggatttctacgcgcgggcgacgcatccggagcgctgcgtggtcggccacccgttcaatcccgtctacctgctgccgctcgtcgaggtgctcggcggcgcgcgcacgtcgccggaagcggtcgaaggcgcgatggagatctatcgcaagctcggcatgcgaccgttgcacgtgcgcaaggaagtgccgggcttcatcgcggaccggctgctcgaagcgttgtggcgcgaggcgctgcacctcgtcaacgaaggcgtcgcgacgaccggcgagatcgacgacgcgatccgcttcggcgcgggcatccgctggtcgttcatgggcaccttcctgacctacacgctcgccggcggcgatgcgggcatgcgacacttcatgcagcagttcggccccgcgctcgaactgccgtggacgaagctggtcgcgcccacgctcaccgatacgctgatcgacagcgtcgtcgaaggcacgaccgaacagcagggcacgcgcagcatcaaggaactcgagcgctatcgcgacgagtgcatcaccgaggtgctgaagtcgatcgccgcggtgaaggcgcggcacgggatgcgattcgaggactaagggactaaaggactgaaggcgatgaccggcgataccccgctgacgatataccgcgacgtggtgcggcccgaatgggtcgactacaacggccacctgcgcgatgcgttctacctgctgatcttcagcttcgcgaccgatgcgctgctggatcgcatcggcctcgacgacgccgcgcgtcgcgagcggggccgctcggtctacacgctcgaagcgcacgtgaactacctgcacgagatcaaggagggcacgcaggtgcgtgtcgatgcgcgcgtgctggcgcatgacgcgaagcggatgcacctgtatctcgagctgttcgcggacgggcatgacgatgcggtatcggcgagcgagcagatgctgctgcacgtcgatacgcgcgacggcgcgaaatcggcgccgttcgacgacgacgtggccgcacgcgtggccgggctgcatgcattgcagcgcgattgcgcggcgcccgcgtatgcgggccgcgtgatcgcgttgccgccgcgccgatagcgggtgcgaaccttcaagcgcggagcgcacacgatgctcgaaccggaaatcgcggcgttcgtcgctgccgtcgacgcgtggtatccggccgacgcggccgtacgctcgcccgtcgagcagcgccgcctctacgaccgcttcgcggccgagtggacgccggccgcgctgccggccggcatcgtgcagcaggacgccgtctggcaggcgcccgacggccgcgcgatcgcgctgcggcgctacacgtccgcgcaggcgcgccgcgcggcacggtgctgttctttcatggcggcggcttcgtcgtcggctcgctcgacagtcatgcgctgatcaccgcgcaactggcggccgatacggggctcgacgtgatcgcggtcgactaccggctggcgcccgagcatcgcgcgccggccgcgctcgaagattgcctggccgtcacgcgcgccgcacgcgacgcgcgctggccgttcgggccgtgcgcgcctccgctgacgctcgcgggcgacagcgcgggcggcatgctcgcggcggccgtggccactgcgttgcgcgatgcgggcgaaggcagtgtcgacggcatcgcgctcgtctatccgatgctcgggttcgaaccgcaatcgcccgcgcgcgaaacggaagcgcacgcaccgatgctgacgctcgacgacgtccatcgctatcgcgcgctgtactggaacggcggcctgtccgatgcgctgggagacggcaatccgctgttgcgcgcgtcggtgccgctcgcggctgcgcgtttcgacggcctgccgcccgtcctcgcgatcggcgccgaacacgatccgctgcgcgacgatgcgcgcgtgtacgtcgaacggattcgcgcggccggcggtgccgcgcactactggatgggagagggctggtgcacggctgctggcgcgcgctcggaacgagcccgcaggcggcgcggatgcaccggacggtcggcgggtttctgctcgcaccacacgcgtagcgggcgtttccggaggcaacgatgcaggcagcgcaacaccgtatcgaggactggcggacgttttcggtcgacgcgaccattgcggcggtcgtgattggcgactcagcggtggacgtcgagtggagcgacacgcgacgatcgccgtttcacttcgactggctgcgcgacaactgcgcgtgctccgcatgcgtgcatgccgtcacgcgtgaacaggtgttcgagatcgccgacgcgcgcgaggatctcgccgcgcgcgcggtgcacatcgaagccgacggcgcgctgcatgtcgagtggaacgacggacatcgcagcgcgtggtcgccgggatggttgcgcgcgcatgcgtacgacgacgcgtcgcgcgccgagcgccaggccgcgcacgggcggcacgtgtgggccggcgacgatgcgacggccatcggcgtgttcgcgtggcgcgacgtgatggaggacgacggcgcattgcgcgcgtggctcgccgcgttgcagcgcaccgggctgacgctcgtcgaaggcgtgccggccgagcgtggccgcgtcgacgagatcgcgcgccgcatcggcctgatccgcgagagcaatttcggtgtgctgttcgacgtcgaatcgaagccgcgcccggacagcaatgcgtatcgtcgctgaacctgccgccgcataccgatctgccgacccgcgagctgcagccgggcgtgcagttcctgcattgcctggcgaacgatgcgaccggcggcgacagcgtgttcctcgacggcttcgcgctggcggatgcgctgcggcgcgagcatccggccgatttcgagcaactcgcgtcgacgccgttcgagttctggaacaagagtgcgaacagcgactatcgctgctcggcgccggtgatcgggctcgatgcacgcggcaacgtgaccgaggtgcgcgtcgcgaacttcctgcgcgggccgctcgatgcgccggccggctcggtcgcggccgtctatcgcgcgtaccggcggttcctcgcgcttgcgcgcgagccgcgctttcgcgtgcagcgccggttgcgggcgggcgacatgtgggcgttcgacaaccggcgcgtactgcatgcgcgcaccgagttcgatccgtcgaccggccgccggcatctgcagggttgctacgtcgatcgcgacgaattgctgtcgcggtggcgcgtgctgtcgcgttcggcgcccgccgcggctgcaccgcactgacgggcaagcgcggcttcatcctgcctgcacacctgccgcgcaggatgaaagcgcccggacgcgaggcgcccgggcgaagccacccgctgccgggcggcggaggtatgcgtttcataaaggacgagccccgcaaggctcgtcctgatgtttcttcatcgcgctgcgcgcggcgcccgtcgggggcgcatcggcttactggccgaagaagatcgagtcgcgagcgttcgacgacgttgcggccggggcgcccgagtggacggccggagccggttgcgcgccgtagccgctggtgtcggcaccatgaacacgcgcttcggcgctctggatgtcgttcgggtagtacgggctcgacaggcccggcttgtagccggctttttcgagctgaaccagttcgttcttcacttgcgcgcgggtcacggtgctttgggcgaatgcgccgaacgaagcggacagggcggcagcggcaacgactgcggaaacgagcgatttcatgatgacctccggtgttttattgggttcgctcttgacaccatgtcttaagcgattgatcgaatcttagtcatcggaaggttcagggtaaacgctgattttgacgatagattgtttcctgggcagtaacagtggcgcgccgactcaggctttcaacgggctttcttatcggttggtgcaacaagtatgaagaatgttgcggaggccgacatgcctttcagcgcgcctcggccgccgtgtcgaacggccggcccggcgaacgtccggccggcgcgcccgagctgaggaagcgcacgcccgtcgcggcttccgatgcctcccacagcaacgccgctgatcctgcgtcgcgggccgcgcgtggcacgctcgcgggcgccggcagcccgcgcgactcgaaccagccggacggcccgatatacgcgccgcccgcgagatcgggcgcggtcgccgcatgaatcgcgggcagcgcccctggtcggccggctgcgcgagataacggttcgcggcccgcatcagcgcggcgcgcgcgggcgagctgtccatcaccgggcccgcgaactgcaggttggttgccgcgtagcccgggtgcgcggcgacgctgatcccggcgaacgccgcgcgctcgaaacggcgctgaagttcgatcgcgaacacgaggttcgcgagcttgctgtcgcaataggcgagataacggttgtagcggcgctcggcgcgcaggtcgtcgacgcggatccggccgccgcgattgaggccgctcgacatcgtcacgacccgcggccggcgcgcggcgcgcagcgcgggcagcagatggccggtcagcgcgaaatggccgaggtggttggtgccgaactgcatctcgaagccgtcgcgcgtatggcgcagcggcaggaacatcacgccggcgttgttgcagaggatatcgacgcggccatggcgttcggccacatcggccgcgaagcgtgcgatcgaggcgagatcagcgaggtcgagcgcgtcggcttcgacgcgggcatcgggatggagccggcggatcgcatcggcggcctgcgcggcgcgggccgcgtcgcggcaacccatcacgacggtcgcgcctttcgcggccagcgtttccgcgagttgccagccgagcccgctgttggcaccggttacgaccgcgaccttgccgccctgcgccgggacgtggcgcgcgctccatgcatgcatgtctgcctccatcggcgcgaccgggtggccgcggcacgtaatcgttacatcgagtggtgtaacgatagtgcgcgtggtcgtggcaggcaagcagggaattagaccggcgcttctagggcttgcgcatcgtcgtgcggcaccgcgtgccgcgatgcgcggccggcaggatttacctgccgccggccagcgcgagcacttcggcggcggagatcatcgccgccgcgttcgcgggcgccgggcgttcggccgggcggaagacttcgtcgccgcgctggatgacctggcgcgacagcgcgcacgtgccggtgcgttgcgcgaagcggcggcgccagcgctgttcaccgtagtgacagcggccgggctcgacccagcggacgacgagcagcgtatcggaacgttcgaggatttcgacgtggacgtcggcgggatcgagcacaggcagggatttggaggccttcattttgccgtttcctaaagctcgtgcggttcgtccgtggcagtggatgtcactacccgatggcgaatccgtagcggtttccatgagtggtgcgctaaatgtaagcgtctgtgaccggaaaaacatcctgtctggctcaaattaccttttgccgatttagaaacaatccacgcttattttcttgggaaaaccacagacaaaaacgccccggacatgaagtccggggcgggaaatcggcctgcgcgccgtgtctgctcgcccagtcacggagcccatcgccggggacggaggtgcccgcagggatcgaacgcgggcggggtggcgatggaccggtggcgcagtccggtacgtcatgatggcgcgtgcatcccgttgagaccctgacgcgaacatgactttttcgccagtttggcgtggcgccgcgccgggcatgcgtgaacaaacggctggatggcccgccggtattgggagtgcgcggatcccggacgggctcccgcgtgccatcgaatgccggatgcttgctcgaccgcccgatttccacgcccgggtaaatactgaatcccgatttcgtgacaaacgcgaagtcgactcctatgattggttggacctttagtcctttgtgccaatcggccgacgggtggccggttttttcgggagagtcgctcatgagattgcagggcaaacgcgcgctggtgacggcggccgggcagggtatcggccgcgcgaccgcgctgcggttcgcgagcgagggcgccgacgtgctggcgaccgacatcaacgaagccgcgctcgtgcggctcgaggccgacgccgaacgcgcgggcagccggctggccacgcggcggctcgacgtcaccgatgcgcaggacgtcgcggcgcttgccgcgaacgagcgcgcgttcgacgtgctgttcaactgcgcgggctatgtccaccacggctcgatcctcgactgcgacgacgacgcatgggcgttctcgctgaacctgaacgtcacgtcgacgtaccggctgattcgcgcgctgctgcccgcgatgctcgaagcgggcggcgcgtcgatcatcaacatggcgtcggccgcgtcgagcgtgaagggcgtgccgaaccgcttcgtctacggcacgaccaaggcggccgtgatcggcttgaccaaggcggtggccgccgatttcgtcgaacgcggcatccgctgcaacgcgatctgcccgggcacgatcgaatcgccgtcgctggagcagcggattgccgaccaggcgcgcatgcgcgacgtgtcggccgacgaggtgcgccaggcgttcgtcgcgcgccagccgatcggccgcatcggcaccgcggacgaagtggccgcgctcgcgctgtaccttgcgtccgacgaagcgtcgttcacgaccggcgcgatccacctgatcgacggcggctggtcgaactgaccgcgcctttccccgctactttccatttccgttcaagacgatatgaaactgctgagatttggcgacaagcaccatgaaaaccgggcttgctcgatgcacaaggccacatccgcgacctgtcgggcgtgatcgacgatctcgccggcgatgcgctggcgccggcctcgctcgcgcggttgcgcgacattccgccgtcgtcgctgccacgggtcgaaggcacgccgcggctcggcgcgtgcgtcggccgcgtcggcaagttcatctgcatcgggctcaactattccgaccacgcggccgaatcggggatggaggtgccgaaggagcccgtcgtgttcggcaagtggacgagcgcgatctcggggccgaacgacgacgtcgagattccgcgcggctcggagaagaccgactgggaggtcgaactcggcgtggtgatcggccagggcggtcgttatatcgcggaagccgacgcgctgtcgcacgtggcgggctactgcgtcgtgaacgacgtgtcggagcgtgaattccagctcgaacgcggcggcacgtgggacaagggcaagggcaacgacacgttcgggccgctcggcccttggctcgtgacggccgacgaagtgcccgatccgcatgcgctgcggttgtggctcgacgtcgacggtcatcgctaccagaacggcacgaccgcgacgatggtgttccgcgtgccgcacctgatcagctacctgagccgcttcatgagcctgcagccgggcgacgtgatctcgaccggcacgccgccgggtgtcggcctcgggcagaagccgcccgtctatctgcgcgccgggcaggtgatcacgctcggtatcgacgggctcggcgagcaacgccagcgcaccgtgcaggcctgattccctttcgcggacgattcgtcatgcctatcattcgatcgatgcgcgtcctcgacgtgcgcttcccgacctcgcgccagctcgacggctccgatgcgatgaacccggaccccgattattcggccgcgtacgtcgtgctcgaaaccgaccgcgacgggctcgaaggtcacggcctcacgttcaccatcgggcgcggcaacgagatctgctgcgcggcgatcgacgcgatgcgtcacctcgtcgtcggcctcgacctcgactggattcgcgcggacatgggccgcttctggcggcacgtcacgtcggacagccagttgcgctggatcggccccgacaaggggcgattcatctggcgacggggccgtcgtcaacgcggtgtgggatctgtgggcgaaagccgaacgcaagccgctatggcggctcgttgccgacctgagccccgaggaactggtgcgcgcgatcgacttccgctacctgacggactgcctgacgccggacgaagcgctcgacctgctgcgcaggcaggcgccgggcaaggccgaacggatcgcgattctggagcgcgacggctacccgtgctacacgacgtcggccggctggcttggctacagcgacgacaagctgcggcggttgtgccgcgaagccgtcgaagccgggttcgaccacgtgaagctgaaagtcggcgcgaacctggaggacgatatccgccgcgtgacgatcgcgcgcgaagtgatcggcccggaccgcaagctgatgatcgacgcgaaccaggtgtgggaagtggacgaggcgatcgactgggtgcgcgagctggcgttcgcgcggccgtggttcatcgaggagccgacgagccccgacgatgtcgaagggcatcgcacgatccgcgaagcgatcgcacccgtgcaggtcgcgaccggcgagatgtgccagaaccgcgtcctgttcaagcagttcatcgcgcgcggcgcgatcgacgtcgtgcagatcgatgcgtgccggctcggcggcgtgaacgagattctcgcggtgatgctgatggccgcgaaatacgggctgcccgtctgcccgcatgcgggcggcgtcgggttgtgcgaatacgtgcagcatctgtcgatgatcgactacgtgtgcatttccggcacgaaggaagggcgcgtgacggagtacgtcgatcacctgcacgagcatttcgtcgaaccgtgcatcgtgcgcggcgcggcctacatgccgccgacggcacccggtttttcgatcgagatgaagcccgaatcgctggagcaataccggttccggggctgacacgcgttgagcgtgccgacaacatgaacgacggagacgcgaagtggatctgaatctgcaacacaaggtcgtgatcgtgaccggcggcgcgtcgggcatcggtgccgcgatctcgatgcggcttgccgaagaaggcgcgattccggtggtgttcgcgcgccacgcgcccgacgatgcgttctggcgcgcactcgtgcagaagcagccgcaggccgcgtgcatgtcggtcgagttgcaggacgacgcacagtgccgcgacgcggttgcgcagaccgtcgcgcgcttcggtcgtctcgacggcctcgtcaacaacgcgggcgtcaacgacggcgtcgggctcgatgccggccgcgatgcgttcgtcgcgtcgctcgagcgcaacctgatccactactacgtgatggcgcactactgcgtgccgcacctgaaggcgacgcgcggcgcgatcgtcaacctctcgtcgaagacggccgtgaccggccagggcaacacgagcggctattgcgcgtcgaagggcgcgcaactcgcgctgacacgcgaatgggccgtcgcgttgcgcgacgacggcgtgcgcgtgaacgcggtgattccggccgaggtgatgacgccgctttaccgcaactggctcgccggtttcgacgaccccgacgcgaagctggcgggcatcgcgggcaaggtgccgctcggcaaacgcttcacgacggccgacgagatcgccgatacggccgtattcctgctgtcggcacgcgcatcgcacacgacgggccagtggctgttcgtcgacggcggttatacgcatctcgaccgtgcgatcagctgagggcagcgctccatgcaacccgacccgaacctgactgccgcgccgccgctgatcgcattgaccggcatcggcaagcgcttcccgggcgtgcaggcgctcgacgattgccgtttcgacctgcgggccggcgaagtgcacgcgctgatgggcgagaacggcgccggcaagtcgacgttgatgaagatcctcgcgggcgtgtaccagcgcgacgacggcgagatccggatggacggccgcgcggtggagattgccgatccgcgcgccgcgcaggcgctcggaatcggcatcatccatcaggaactgaacctgatgaaccacctgagcgtcgcgcagaacatcttcatcggtcgcgagccgcgcggccgcttcggcgtgttcgtcgacgaagacacgctgaatcgcgatgccgccgcgatcttccagcggatgcggctcgatctcgacccgcgcacgccggtcggccggctgacggttgcgaagcagcagatggtcgagatcgcgaaggcgctgtcgttcgactcgcgcgtgctgatcatggacgagccgaccgccgcgctcaacaacgcggagatcgccgagctgttccgcatcatccgcgacctgcgcgcgaacggtgtcggcatcgtctatatctcgcacaagatggacgagctgcgccagatcgccgatcgcgtgaccgtgatgcgcgacggcaagtacgtcgcgaccgtgccgatggcggatacgtcgatggacgcgattatcgcgatgatggtcggccgccagctcgcgacggaattccgcacgccgcccgatacgtccgcgaacgacgtcgcgctcgaagtgcgcgggctgtcgcgcggccgcgcgatccgcgacgtcggcttcacgctgcggcgcggcgagatcctcggcttcgcggggctgatgggcgcgggccgcaccgaggtcgcgcgcgcggtgttcggcgccgacccgatcgacgccggcgagatccgcgtgcacggcaagaccgtgacgatccgcacgccggccgatgcggtgaagcacggcatcggctatctgtccgaggatcgcaagcacttcgggctcgcggtcgggatggacgtgcagaacaacatcgccatgtcgagcatgcgccgtttcgtgcgccgtggcgtgtttctcgacgcgcgcgcgatgcgcgacaccgcacacgcgtatgtgcggcagctcgcgatccgcacgccgtcggtcgcgcagcccgcgcgcctttgtcgggcggcaaccagcagaagatcgtgatcgcgaagtggctgctgcgcgactgcgacatcctgttcttcgacgagccgacgcgcggcatcgacgtcggcgcgaagagcgagatctacaagctgctcgacgcgctggccgccgacggcaaggcgatcgtgatgatctcgtcggaactgcccgaggtgctgcgcatgagccaccggattctcgtgatgtgcgaggggcgcgtgaccggcgagctgcgcgcggccgacgccacgcaggaaaagatcatgcagctcgcgacgcagcgcgagtcgaccgtgttgtcctgattcagacgccgatccatacgcctatccgatcatgtccaacgatacgcatcccgttccgccctcgcgtccgccgatacgcctgccggcgcatcgagcctgaagtcgcgcttcttcaaccccgccgcgcgccagaagctgctcgcgttcgcgagcctcgtgctgctgatcgtgttcttcagcttcgcgtcgccgaacttccttgaagtcgacaacctcgtcacgatcttgcaggccaccgccgtgaacggcgtgctggcggtcgcatgtacctacgtgatcatcacgtcgggcatcgacctgtcggtcggcacgctgatgacgttctgcgcggtgatggccggcgtcgtgctgacgaagtggggcatgccgctgccgctcgggatcctggccgcgctgtttttcggcgcgctgtcgggttgcgtatcgggcttcgtgatcgcgaagatgaaggtgccgccgttcatcgcgacgctcggcatgatgatgctgctcaaggggctgtcgctggtgatttcgggcacgcggccgatctacttcaacgacacgccgggcttcacgtcgatcgcgcaggattcgctgatcggcaacctcattcccgcgctgccgattccgaatgcggtgctgatcctgttcctcgtcgcgatcggcgcatcgatcgtgctgaaccgcacgatcttcggccgttacacgttcgcgctcggcagcaacgaggaggcgctgcggctgtccggcgtgaacgtcgacgcgtggaagatcgccgtctacacgttcagcggcgcggtgtgcgggatcgccgggctactgatcgcgtcgcggctgaactccgcgcagccggcgctcgggcagggctacgagctcgatgcgatcgcggccgtcgtgatcggcggcacgtcgctgtcgggcggcgcgggcagcatcgtcggcaccatcatcggcgcgttcatcatgagcgtgctgaccaacggcctgcgcatcatgtcggtcgcgcaggaatggcagacggtcgtgacgggcgtgatcatcatcctggccgtctacgtcgacatcccagccggcggcgccgctgacacacgtatgcacgcaggcatgtgcttcaccgccggttccggccggcgttccagtcgttccagtcgatacgaaaaaggagacgcgaagtgatcaggagcaaggtgttgaacgcgatcgtcgggctgacgttcgccgtcggcgtcacggccggtgcgcacgcgcaggaagcctacatcccgctgatctcgaagggcttccagcatcagttctggcaggccgtgaaatcgggcgcgacgcaggccgcgaaggactacaaggtgaaggtgacgttcgaagggcccgaaaccgaggcgatggtcgacaagcagatcgacatgctgtcggccgcgatcgcgaagaagccggccgcgctcggcttcgcggcactcgacagcaaggccgcgctgccgctcctgaagaaggcgcaggccgagaagattccggtgatcgcattcgactcgggcgtcgacagcgacatcccggtgacgaccgccgcgaccaacaacaaggccgccgccgcgctggccgccgacaagctcgccgcgctgatcggcgacgagggcgaagtggccgtggtcgcgcacgaccagacgagccgcaccggcatcgaccgccgcgacggttttctcgagcggatgaaagcggcgcacccgaaggtgcaggtcgtgaccgtgcagtacggcgaaggcgaccagctgaagtcgaccgaggtgacgaagtcgatcctgcaggtacccgaagctcaaggggctgttcggcaccaacgaaggctcggcgatcggcgtggtcaacggcgtgcgtgaaatgaagcgcaaggtcgtgatcgtcggctacgattcgggcaagcagcagaaggacgcgatccgcagcgggctgatggccggcgcgatcacgcagaacccgatcgggatcggctacaagacggtcgaggcggccgtgaaggcgatcaagggcgagaagctgccgaaggtcatcgataccggtttctactggtacgacaagaccaatatcgacgatccgaagatcgcggcggtgctgtacgactgaacgccgtgccacggcgccgccgcgcgcgcgcatagcgcgtgcggcggcgcgggcgggcggagcagaacacgaggacaccatgggcgcagtgcgtatcgattcccatcagcacttctggcgttatcgcgcggccgactatccgtggatcggccccggcatggaggtgctcgcgcacgactacctgcccgacgcgttgcggccgctgatgcatgcgcaggcgctcggcgcatcgatcgcggtgcaggcgcgcgccgggcgcgacgagaccgcgttcctgctcgatctcgcccgcgacgatacgcacatcgcggcggtggtcggctgggaggatctttccgcgccgcagcttgccgagcgcgtcgccgaatggtgcagcccgaagctgcgcggcttccggcaccaggtgcaggacgaagccgacgccggcgcgttcgtcgccgatcccggtttcaaccgcggcatcgcgtggttgcaggcgaacggttacgtgtacgacgtgctcgtgttcgagcgccagttgccggacgtgcaggcgttctgcgcgcggcacgatgcgcactggctcgtgctcgatcacgccggcaagcccgcgctggccgaattcgagcgcgacgaatcggcgctcgcgcgctggcgcgccgcgttgcgcgagctgggcgcgctgccgcacgtcgcgtgcaagctgtcggggctcgtgacggaggcggactggacgcgcggcctgcgcgggaaggacgtccggcatatcgagcagtgcctcgacgcggcgctcgacgcgttcggcccgcagcggctgatgttcggttcggactggccggtgtgcctgctggccgcgtcgtatgacgaagtcgcatcgatcgtcgagcgctgggccgaatcgcggctgtcggcggccgagcgcagcgcgttgggcgggacggcggcgcgttgttacgcggtgccgggcgacgcgaagcgcggcatataaaataggcgcgaacggcccgtgcgcttcgccgggccgtccgcaatgcaaccgatcaccagcatcaacgtatgtccatccagccgatccagaaccgccgcctgtaccagcagatcgccgacaagctcagtgcgatgatcgagtccggcgattttccgccgggcagctacctgccgcccgagcgcgaactggccgaacagttcggcgtgtcgcgcacgtcggtgcgtgaagcgctgatcgcgctcgaagtgagcgggctcgtcagcgtgcgcgtcggcgacggcgtgaaggtgcgccaccccgaaacggccgccgcacccgaacccgcgcccgacctggcagcgaaggccgcgccgttcacggtcatcgagatcgatcccgaactcggcatcgcactcgatctcgataccgaaatcccgccgttcgcgctgttgcaggcgcgccggctgatcgagccggaagccgcgtcacttgccgcgaagcatggctccgacgagcagatcgaaggcatccacgaggcgttcctgcgcaaccaggaagacaaccgcagcggttcgctcacgcatccgggcgaccggctgtttcatatccgcatcgcggaagcgagcgacaacgccgcgtacgcgctgatgatcaagcagttgctcgcgcacaagtacgacctgatgttccagcggttgcagtcgctgtacatgccgaacgacatgccgcaccgatcggaactggagcaccgcgcgatcctcgatgcgatccgcgcgcgcgacccggacgccgcgcgccgcgcgatggccgagcacctcgacgaagtgatccgcatcttcgggcgcgcgctcgactgagcgcgcgtcgatgcgctgcgcggtcagaagcgatccgcgcgatacggcgccggatcggtgaacggcgcttcgcccgtcatcatctcggccagcaggcggcccgtgacggggccgagcgtcagcccgtgatggttgtgcccgaacgcgaaccacagcccgcgatgcgcgggcgcggggccgatcaccgggcgcatgtcgggcgtgcacggccggaagccgagccacggttgcgggtcgagccgctcgccgaaaccgaacacggggcgcgcgacgcgttccgcccgttcgagctgcacgccggtcggcggcacgcggcggcgcgcgatctcgacgccggtcgtcagccgcagcccgcgcttcatcggcgcaatcacgtagccgtattcgcgatcgacgatcggcgccgacggcacgccgcgcgcggacggcgcgtaatgcatgtgatagccacgcttctcgcgcagcgggatcttgtagccgaacttgccgaacacggtgtcggaccacgggccgagcgcgacgacgacagccggcgcggcggccgtgccgtcctgcgtgttcacttgccagccgggcgagcgtgcgtcgaggctcgcggcgtcgccggtcagcagcgtgccgccgccttgcacgaacagatgcgcatacgctttgacgagcgcggccggatcgacgacgcttttggatcgagccagtgcaacgcgccgcagaaaccggggcgaggctcggttcgtgcgcgagcagcgcggcggcatcgagcggcgtgatgccgagcccgtggcggcgcgcggtaaggccggcttcggcgacgccgcgttcgaatgcggcgggcgtgcggaacgcttccagccagccgttcgcgcggatcagttcgccggcaccggcccgtgcgatcagcgcgtcgtgctcgacgaggcagcgttcgatcagcggcagcatgtcgcgtgaagctgccgcgtggcgcagcggcgccgattcccaccagaaacgcgcgagccaaggcgcgaacgcgggcagcgacgcgctgtgccagtagagatcggtcgagcggttcagcgcgtagcgcatcagcgtgaacgggctgcgcgggaacggatacggctcgaccgacgagcgctcgatcagccccgcgttgccgaagctcgtgccttcgccgggcgcgccgcgatcgacgagggcgaccttgcgtccgcgatcctgcaggtgcagtgcgacggagacgccgacgatgccggcgccgagaacgatgacgtcgaagtccatgggtggtggtgagtgacggttagccgggcgagcgcgagatcgtggcggttgtttcgcccgaacgggaattcgttcgaactgcaagcatactcgcgacggcgcggggcgtgttgcgggctgcgagttgtcggccgctcgcgcgtcagatctcgattccgtgttccaggagccgggtgcgcagctcctcgcgatgatcgcgtgcaaccgtcgccagcaggcgtgttgcttgcggcgtgtcgagcatcgcgcgctgcgccgcgccggggcgcgtccacatcgagacaggattgcgcagccacgtttgcaggtcgcgcgccagcgcgtcgtccgatcgtccggttgctcattgcgcgcggcaatcagcacgatgcacacgagactgtcccactgatcccgtgagcagatcgcacgtgcggcatggcgatcgccgtatcgctcgagcacctgttcgatttgcgcgagcgagacgaatgcaccttgctcgcacaggcgcaccgcggttttgcgaatcctgcgggcggggtccagcagcgcgcgcggccacctcgtcccggatcgatggcgacagccgagccagcagcacgagtgcgtgcgcacgaaccgggctgcgcgcatccgtcgagaaccgctccatcgtcgctatcgcggcgggcgcgcgcagttcggcgagcaacgacagcgccgcgcgaacccgggtgccggacaacgtgcccgtatcgagcagcgcaacgcagcggtccgcgacattccggccgagttcggtgagcaaccgggccgccgcggcgcgcaagctgctttgcgaatcgagcgttgaccgccacaggaacgcctcggcgccgtcgtcgatgccttggtcgatcatgtaagcgagtgcggcgcggcgaaccgggccgaacggggagtcggccgcgagatcgatgcagcgcatgcgatcgcttgccggcacgtcgtcgagcatcgccaccgcccgtcgggcgagcacgatgtcgccggaggtcaggccgtgcgtgaccagttcggcagccggcaggatccggtgatcgaatgccacgaggcaagcgatgcgccggagctggaagtccggggcgtgcatcgcgtcgacgatcgtatcgacgccgcctgtctgcaccagccgctgttcgaatgcgtgcagccatgggccgtgatcttcgcgcgtggccgacgtgagctgacgcaacgacggaagcagtgcggcgaagtacctgggcggcacggtcgcgagcagtgtgacgagtgcgttcgtcgcggcgcgccgcacttcgggcacccagtcgttgatgcgtgcggcaatcggttcgagcagtgcgctgtcgccaagctcgaccgcgcgggcgatcgccgcttcgcgaacatagcccgagtaatgaccgatcgcctgcgtgagcagcgcgacgtcgcggctcgcggcgatcttctgcagcgcgtcggcgagcggcatcgcctggccttgctgcaagtagaccgtgtgcgagggcgccgtggacggtggccgcgcgccgaaaatcctggcgatgaggttcattggaatcagcgaggtgagatgacgtgcagtttcgtcggaagaatcgacggtgccggccattctacgtcagtggctttctcggcagcgggccgtcaccggatgcgacggcccgcgttcgagcgaatgcccggccgcgtgcgtcgcgtgctcgctacgccattgcgaacggcgcatcgcaagacatcccgttgcggccgatccgttcgtaccgaggcaatccacaatgcaaccggtgcgccaatccgccgatcaatgcttcggtgctgacactgaatcgaagacgatgttcgcagtcacgcgcagcgtcgcgagcaagccgcattcagcgtgcttgccccgcttcccagcgggtgtttcccactggtggatcacgcggatttttacctaagatgaagcaatcgtgcgcgtgatacggtgcctggtcgcgcacggagggaggcgggaggcagcgccggagcgacgcaagcggatgttgccatcatggatgcgaaagtgtgcgcggcggctgccggttttgcgacggcaacgacgccaacgtgcgcggcggcgatcgccgcgcggaagacgggccggcccggccgtaccgcttcactgcgccacgcacttctcgcaatcgtttgcgttctggggcggcgccggccgtgctcgcgggggtacccgccgacgcggacggtccgtccgacaccatgcacatcgccgccgccgcaagccctgccgattccgcggcgacacccgatcacgccgttttgtcacacgactccgccgtgcgtcaggtcgtgctcggcatcgtcagcttcacgcgctggccgaccatgcccgttcgtttgcacctgtgcgtcaccggccgccccgactacgcgcgcggcctgaccgatacgctgcaggccggctcgacgctgctcgacgtgcagcacgtccgcttcgacgatccgtcgctcggcatcgcgtgcgacgtcgtgtatctcggcaccttggacaacgacgagagaacgcgcgtcaggagtgcgctggccggccatccggtcctgacgatcgcggagcacgatccgtcctgcaccgcgggcggcatgttctgtctcaatgtcgacggcgatcgcgtgtcgttcgacatcaatctcgatgcggtggcgcgcagcggcgtgcgcgtgcatccgaacgtgctgaatctcgcacgacggccgggggcgccatgatgcggcccttgctccacctgcccccttcgcgcatgccgcgccccacgctgcaaagcgtgctgcgccgcgcgcacctgcgcctcgcgttcgtcgccgtcgcgatggcggccgtgtcgttgatcgtcgtcgccgtgatcgcgttgcgtgcgtatgccggcaacaacctgaacctgctggcccgctcgctcggttatacggtcgaggcggcgctcgtgttcggcgatcgcgtcgcggcgaacgaggcgatcgggatgatcgcgagcgaggaagacgtcgcgcaggtcgtcgtcaccgacagcaacggccagccgttcgcgatgtggcagctgccggcaggcaacgggatcgcgcggctcgagcgcatcgtggccgacgtcgcgctgcccgggcccgtggcggtgccggtcgtgcatgacggcatcgtcgtcgggcaggtcgtcgcgcggccgcgggcaccagttcttcggcttcctgctcggcggcatcggcggcattctcggttgcctggccgtcagcgtattcggcgcgtatgtgagctcgaaacgcctgctgcgcaacatcgtcgcaccgctgcgtgcgctcgccggcgtcgcgcacgcggtgcggcgcgaacgggcattcgcgcggcgcgtcgaaccggcggcgatcgcggaactgaacgagctcggcgacgacttcaatgcgctgctcgacgaattcgaagactggcagaacacgctgcgcgacgaaaacgcgtcgctcgaacacaaggcgacgcacgatgcgctcaccgggctgcccaatcgcgtgcagttcgagtcgcgcctggcgcgcgcgctcggcgacgcgaatgcgacgggccagcgagtcgcgatcctgtatctcgactgcgatcgcttcaaggagatcaacgattgtctcggtcacgatgccggcgacgcggtgctgatcggcgtcgcgtcgcggctgcgcacgcaggtgcgcgagaccgatctggtcgcccgcctcggcggcgacgaatttgcggtgatgctggcgggcgtgcccgaagcgggcagcgtgtgccggatcgccgacgagatattgtccggcatggcgccgtcgatcgagctgtccgacggccgcatggtggccaccatgatgagtgccggcgtagcgctgtatcccgaccacgcatcggacgcgagcggtttgctgcgcgcggcggatgcagcgatgtaccgggccagcgcgcccggccaggctcgtggcagctggccgaaggtgtcgcgggaccggtttgatcgattgcttcgcgctgcgggcgaggccgcagccgcggatgacaacaagcgcgtccggcgcgggcgcactcgaaggggatgcgaaatgaaccactcgtttcctgtgggcatcgggcgtacgtgcgtctggggcgcgctgctgctgtgcatgctgctgggcggctgcaagacgccgccgcttcatcgcgggctgacgcagacgcaggtcacggcgctcaagtcggccggtttccaggaaacccggcagggtttcgaattcggctcgaccgggccgatcctgttcgatttcgatcgctacaacctcaagcccgatgtgcggcggatcgtcgagcggatcggacgcacgctccattcggcggggatcaacggggtgcgggtctatggttatacggacgaagagggcgtggacgactacgacgtcgagttgtcgcgtcggcgtgccgaggtggtggcgatcgagctcgtcgatctcgggctggacccgaagcgtatcgcggtcgtcgggaaagggaagctcgacccggtgggcgacaaccggacaccggcgggccgcgcgcagaaccggcgggcggcgatcgtggtttcgccgcgctgaggtttcgtttcggcggggcggcgcggcgggtgccgcggaatgccgggcgttcgctccccgcgaacagccgatcgtcatgcccctgacatgctgacgtggcgcattaccgggtgaagcagtcttcgacgaccggatggcgctgctcgacgcattcgagccggggctttcacctgcccggacgaaatcgcccccgccggctccttgaatacttcctcgccatgggtgcgccgagggcgatcctgccccggaatcccgctgccagcctggtttcccgattttcggggcgcgagcgtaaacgtttgcgagtggcttccgcgctgtcggaatttgtcctacattatcggggcttcgggccggccagccggcctacggaacctgagatcatacgcaaggaacaagaatgagtttcgctccgaacgggggtattcccaatggtttgggcggcggcgggctgggctcgctgagcgcgctcggcggcctggccggcccggttgcgtcgagtgttgccggcagcctcgggccgctcgcggggctggccggccacgtcgacaccgtccagcgcgcgatgcagctcgcgcagaccggcttctcgctgatggacaagacgcccggcgcgatcgccgaggcgatcaacggcgccgccaaccccgcgcgcctgacccagctcaaccgctacgtgacgctcgatacgccgctcggcccggatgtgctgctggtcagcgccgccgtcgtcgacgagcacgtgaaccggttgcccgagatccacctcgacctgctgtcccatcgccacgacctgcgcccggaagacctgatcggccagcaggtcaagatccggttcgaccagcaggcgcgcctgtcgacgctcgagcgcgtcgtcgcatcgggtaccggcgacaacgaccgctacttcgacggctacgtggcgtcgttcgaccgcgcgggcaaccccgggaacgtcacgcagtatcacctgacggcggtgccgtggttctggttcctgacgcgctcgaccgactgccggatcttccagaacaagaccgcgcaggacatccttaccgagatcttccaggagcacgggttttccgacttcgtgttcgatatccggacgagccagaagccgctcgagtatgtcgtgatgtaccaggagagctactacaacttctgcgcgcggctgatggagcaggaggggctcgtctggacgcaccgctacgagaaggacaagcacttcctggtgatcggcgattcgaacctgctgttccgcccgatcgacgggctcgccacggtgccgttcgcggcgaccgaggcgagtgaggacagcgggatcgatcagttgcacgaaggccggcgcttcggcgtcggcaaggtcacgttccgcgacttcaaccaccagaacccgtcgtcgccgctgatgctggtggaggccgggccgcagaacctcaagcatgcgcggctcgacgcgaccgagcggttcgagcaccagtcgctgtacgaccacggcgatgacggcaaccgttacgcccgttttgcgatggaggccgaggaggcgcaggcccaccgctataccggcggcggctacgcgtggcgcatgaccacggcgggcgcggtcaccgtggcgaatcacccggtgctcgagaacaaccaggagtacgtgatcctgcacgtgcgtcacgaggcggtgaacgactacacgcagcacagcgcgaagctgccttaccgcaacagcttcgcgctgctgccgaagaaggtgccgtatcgcgcgccgcgcggcacgccgaagccggtgattcacggcacgcagtcggcgatcgtcgtcgggccgaagggcgaggaaatctataccaacggcagcgcggtgaaggtgcattttccgtgggaccggcgcggcaagaaggacgggtccgattcgatgtgggtgcgcgtgtcgcaaccgtgggccggcgacggctggggtgcggccgcgattccgcggatcaagcaggaggtgctcgtcgcgttcaaccagggcgatccggacaacccggtgatcgtcggccgcgtgttcaacggcgagcaaggcaacccgtatcacggcgcggccggccagacgatggggatcaagagccagacgcacaaggggcaggggtcgaacgagatccgcatgaccgacacgaacggcatgcaggaattcttcatgcacgcgcagaaggacatgaacaccgtcgtcgagaacaacgagacgcacaaggtgctggggccgatgcgtaccgtgctggtggccaccggcagcgaagagaagcagattccgcagggcaacctgaccgagacgatcgccgagaagcgcagcacgaccgcgaccaccgtcgaggtgacgacgccggccaaggacgggggcggcggcacgcaggtttacatggccgagcgaggcatcctgctgaaggtgatggacagctcgatctcgcttgcgccggaaggcattcgcctcgaacacaagggctccgtgatcctgatgaccgacgacggcgtgatggtcaacggcaagcgcatcgatctcaacaaataaaacgaacgaaaccagccatgcactacgcaattcacgaaggcacttttgaactgccggacgcggcgcttgatcgtacggtcaacatcctgatgatgaacgccggccccggcggcctcaatctcgtgatcgctcgcgggcgcttgcgtgacggggagaatctcgacgcgttcgtcgcgcgcgaatgggaagtggcgtcgcgcgatgccaggatgctgaccgagaaagcacgccggcccgtgacggtggcgggtcgtgcgggcgtccagatcgactccacgcacgaacgggacggccggctctggcatcaggtgcagaccatgtttccgtcggacgacgccggccgcgtgctggtgatgacgttgaccagcgcggcgccgctgaccgacgagcagcaggcgatcgccgaccgcatgctggccagtttccagccgcgcgcggcgcgaccgaccctgctcgggccgggtgacgcgtcgtgagcgcggaaaacttcgcggccgctcgcttcgaagatccgatccagcacacgtcgtttctgggtgaactggtcggtacggtcggatcggtagtcggcggcgccatcgtcggggcattggtggcggaggcgatggagggctgatattcgccggcctcgccgcgctcgagatcggcacggccgggctggcgacgccgctcgtgatcgcgatcggcgtcggcgtggccgttggctcgggcgcgctgatggaagcgagcgggatgaacgaggccatcgacgacggcgcgaaggcgctggccaattcgatggtgccgcccgagatcaagggcaagatcgcgagcggatcggggaacgtttacgtcaacaacaagaaggcggcgcgggcggcgaagccgggcgatctcgataccgttgcgtgtaccgatcatcctgggccgcagatgattgccgatgggtcgggagtgtttacatcaacgatcaaccggccgcgcgggtcggggacaagaccacttgcgacgggacgattgccgaaggttcggacaacgttttcatcggcggcggcacgcagcgggtgaggatgtgaagtcggctacccggctcggatggctgggggcggcgctgggtattgcgctcgcggtttgcgggcgcgggaagatgagctggggcagttcctgaagagcaaggtgccgtgtcttgcggtgaattttgcggcgggtgcgttcggtacctggctgggtagccttgcgaggccgtcggcagggcatccggtcaacgtcattaccggcagcaaggttctcgacggcacggacgataccgacttcgtactgcccgggccgttgccgatcgtgtggcagcgtttctatagcagcctcgatgatcgtgccgacagcctgttcgggacgggatggagcgtgccgatcagcgtcgaactgcggctcgcgcgtgaacacggcgaggttcagtcgatcacttactgggacgagcaggggcgcgatatcgtgttcccggctgtgtcgccgggtgagagtcacttcagcgtgcctgaaggcatttacctgatctgcaccgcgggtggccactatgtggtcgagacggtcgatggtgtgtatcgcgatttcggtcgtgcccggagcgatgcgggtgacgagacgctctgctgtggcgtctcgaggatcgcaatggcaactggatcgaggtggagcaggaagcggccggtgaggtcgtgcggccggcacgactgcatgacagcgctgggcgcgtcgtggcgttcgcctacgacaagtcgcaccctcgacgcatcgccgcgatcgagctgacgcgtggcgtggacggtgagcaacccgacacgctggtgcgttacgcgtacaacgatgctggcgagctggttgccgttaccgaccgcagcggctatatcgcgcgacgtttcgcgtacgagcgtagactgatggttcagcacacgttgcgcggcggcttgcagtgtttctatgcgtgggagggtgttgggcgcgatgcacgtgtcgtgcgccactggaccaacgacggcgaagcgtatacgttcaacgcggatctcgcgcagcgtacggtgacgatcaccgatcagatcggccgcgtgacgcagtggacgtggaacgaggatcagcagccgacgagtcatacggatgccgaaggccatgtgtggcggttggagtggaacgcgaagcggcagttggtcagtacgactgatccggcagggaacacgacccgcttcgaatatgacgagcgcgggcggcagacgcagcgtatcgatgcgctcggccaagtcgagcggaccgagtggaacgggcactacgatctgcccgtcgctgaaaccgatccggccaatgcgcgctggatctatcgctacgacgatcgcggcaacctgacgatgacgcgcgacccggcgggcttcgcgaccgagtatcaccgggatgaacgcgggttggtacacacgatccgcgatgcgcggggcggttacaagttcctcgaatggaacggccgcgctcagttgacctcgtacacggattgttcaggcaaggtcacgcggtttgcatacgatgcgcggggtacgcttgcgcgcgtgaccgacgcgatgggccagtccaccgtctatgaaacggatgcgatggggagggtcacggggatcgggacggccgacggtgcgcggcagatgtttcgatacgatgcggccgggcggctcgttgaagttgtcgatgcgaaccagcgcagcacgcgctatgaacttaatccgcgcggattgctgatagcacgtacggatgcggctgatcgtgtcgtgcgattcgggtacgacgatgcgttccggctcgcgagtttgaccaacgagaatcgtgagacgtatcgcttccagtatgaccgtcgcgatctggtttctgcgcagatcggactggatggtcacaagcgtacgtatgaatatgacgtgtgcggccaaggcacgagtgtccgggatggacagatcgagacgcgatacgagcgcgacgcgatcggtcgactgacggcgaagcaagctgcgcatgagcggtgtgaatatctgtacgacaaggcgagccgaatcacatccgccgagttgtacacgctggctgctcgcggcccgtcgctgaagaatcgggtcagcttgaaatacgacgctcgcggtgaggtcgtcgaggaatacacgccgaccggctggctcgcgcatacctacgatgaactcggcaatcgcgtcagcaccacgatctccggcgagcgcacgatcgactggctgcattacgggtcgggacatgtgcaccagattcgcgttgacggtgctgcggtcgccgacatggaacgcgatgatctgcatcgcgaggtgctgcgaacgcagggcaagctgaccagtcatttcggatacgacgcggtaggccgtcgcgcgcggcacgctgcgcagcgtggccatgcggctgacgatctgcttgcgaagcagtggcaatacgatgcagcgggcgacgtgatccagaagcgcgatcagcgttatggcacgacgaactatcggtatgacccgacagggcgcatcgaacaggctgcggggccgggattgccgtcggaggtgtttcgctgggacgcggcggctaacctggtgtcgagcgatcacccgggcggctacgtcgagcacaaccggctcaagatgttcgaggataagcgcttcgagtatgacgtttatggtcggctggttcgcaaggtgagtggtcatgggcctgccaaggaactggttcttgaatacgacgattggaaccagttgaagaccgtcgtgacgaaggaccggcttggaatctcgacgacgcatttcgagtacgacgcgttcggccggcgggtccggaagctcaatggcagttacgcgagtacggatttcctgtgggatggcatgcggctcgtgcaggagacgtatcacgaccgccagggtgaggaagcgctgacgtatttgtatgaggctaatagctatgtgccgcttgcgcggatcgatcaaggaaggcggctaatgatgcggatgtgcgggacgcggtttattacttccacaacgacgtttcggggttgccggaggagctgactgacgctgggggcgagctggtttggcaggcgcgctacaaggtgtggggcaatgcgctgcaagaggagtgggttgcgcgagtgtcagatcgaccgacagcggtgtggggagacgctcaagcggctgcaccggtgcccgctcacgtaccgcgaccgcagaacttgcgctttcaagggcagtacctagaccgcgagacagggctccactacaacacgttccggttctacgatccggatattggacgtttcatcaatccggatccatcgggcttgccggtgggcgcaacctttatcaatatgcgcctaacccgatctcgtggattgacccatggggatgggcggtaactcctctggatgcgcccgggtactcaacgtatggtctttatgagcccggggcgaatgaaccctactacgttggccataccggacaatcgctcgacgatcgcctttctgagcacgtaggcacaggacgagccgttcgagggcggacagaaattcgctctcttgaagggcccggcgggacgttgacatatagtcaagcaaaggggtatgagcaagcatatagagagaaattcaataccaaaaccgggttcccaggcaatgtcattgagcctatcaacaagttgagaacagatgagcgcggtctctctcatgtgaagttttataatgaaaaggcgaaggaagttgggctaggtcgatgtggaggtaagtgatatggcgttattgaaagtaaagccgggcgatgttgttgcaattcccagtgaaatgaacggagaatggggtttgtgtattctcgagtgatttttgttggggcgacaaagtggattgaagtttttgatgaatttaatgtcgacttcgaagtggtgttggatggtgcgaagtctgaaaattaggaaaaaatctcgcctgtttaatccaattatggcgtcttttgattttgggaaagatttttgctctgtaaagtggcctgtattatcgtcggatcatttatatgcgtcggatcagtctaatttcgcggaaatcgaatttgaagggccgtcgtatcaagagttgggggtttattacaagggtggtgataaattcatcgagaagaaaggggtgcgcaggaatttggatgatatgacaatattttccaatccgcagctcgttaggcggataaatttgtatctttccggatatatcaaaaaggtacggcatggaactcgcgactggtaaaatcgattattgaaaaagagggaatggattggtgggtgggtggaataaacgcatgcaatgacaaagcagatgcggttacgcttgtattcaacgagtggcgtaccaaaagaaacgtgggtcgcgcacgtagcacagcggccgaccccggcgtggggagttgcacaaggggcggcgcggacgtctgcccatgtgccgcggccgcagaacctgcgttttcaagggcagtatttggatcgagaaaccggcttacactacagcacgtttcgattctacgatcctgacatcgggcgcttcattaatccagatccgattgggttgttgggtggattgaacttctatcagtacgcgccgaaccccgtcgggtggattgatccgttcgggctggcaagttacgacccaggggtgtacgacgttcacttcgaaactcggctaccgaaagatatgtatcgcttgactgatgcagagcatttcagcgaagggaacagacagcttcactacgcgatcaagaatgacccggtgctcgcttcagcactcgaggcaaggtatcccggaatttctgaatacgttgctccaacgagactcggtacgtttagaggaagagcatttagcggtacaacttggcatcaccgcggtcaagtgggcgggcttttgcaattggttgaccgagcggatcatgcctcgcgtcatctcgactatcgcgcgaatggtgttggtggtcgaaatacatggggtggcggatcaggctgtcgttaatttggagatgcgtatgaaaatctataattcgattcaagaatttcttggagagctgggggctcaattgggactcgactatttttattaaccaatctgattgggctgttgatccgttgcatacggaaattatctttctcgaaggggataacgagctcgaagacgttgttcctggaactcatttgccaaaatttgcaaatgacaaagggtgcggcagcttttcgatgcagagacatttcgagatatggttgatttcgagcggagaagaaatccggaggcatctgttctcgatattattcatgctatcaattactgctgcgaaaaagatgacttctgcgatcctcggggatagccgaagggccgcctggcgatggtttttccgggcggagctagatgtccaaagctagaggtcggaaatttgtgcggtaaccatgaaaatttacaatgctcttattgatctgattgaaaatgtacagcctttgccggggaaggattggatttatgcgaacttggattcgtggagagataatccgacaggtacgaggtttttctatattccatgggattgcattcaagatctggatgatgatgagatttatttggatgtggaggatatggagatgccgaagtcggttgaaaattatgacttgagatgctggatgttggtaaatcagttgaattacattaggaagaataaggatgataggggtgagggtattgagtggtttgttgatgaagtaaattattatcgtgagaatgacgaatttagaacttgatttttaaggggtgctatgtcgcgcgagatggttatttcggactgttttgagataagcagcagtctccgcttggattgggcatagcgtttctgaaagaggattgtgttgaaaggtaacgaaaaattgaattgtcggtaagtgcgggcatcacgattccttgtgggcatgggtcggctaaagatctcacacttaaatgcgacgattggatccagctcaagaccgtcgtgctgacggatcggctcggaatctcgacgacgcatttcgagtacgacgcgttcggctggcgggtccggaagctcaacggcagttatgcgagtacggatttcctgtgggacggcatgtggttggtgcaggagacgtatcacgaccgtcagggcgaggaagcgctgacgtatttgtacgagtcgaatagttatgtgccgcttgcccggatcgatcaagggaaggcggcggccaatgatgcggatgtgcgggatgctgtctactattttcacaacgacgtttcggggttgccggaggaactgaccaatgccgatggcgaactgacctggccggctcgctacaagatgtggaggagcgcggtccgggaggattggatagcggccaattccgacatggggcgaagtgcaggggaccgcatcagaacctatttccgtgccgcggccgcagaacctgcgtttccaggggcaatatctagatcgggagacggggctacattacaacctgttccgatactacgattctgacgttggacgttatattagtccggatccgatcggtctggtaggtggggttaatctatatcaatatgccaataacaatccgataagctggattgatccacttggattgtttggatatgctccaaaagcacgtaaacatatcctctatggcgatagtcctacgagtggcgggcatacgcggcccggtaatcctgggaaagctgtatttccagaatcgtgggatgcaacaaagattatttatgaggttgacggcgttgttgattctccgaacgccaaatggtacgcccagacaggaaccggcggggctcttgctaaggcgggagaaccggccacgtgggtgtcttgggaagtgagggatggtgtgcgaattcgcactgtttatcagcctgctgttggtcgaatcgtgacagcattcccggacaatgaatctattccgattttaccggaggaaaaataaatggaagatttggagagattgagggtgcttggagaggggtttaatggtcgtctttccgaaattgaaataaaatttgcgttgggatatatcgatttcaatgaggcacccttggctctggatgcactgtgcaattatatttgcgagcatgatgttggtgtttcgatggatgagtatggcgagatcatattgttgaatggaaattttgggtctcctctcgggaggaaaattatttcatatttgaaaaatttaatttcaaacgatcagtgacaactggtagctgggatctgggcgtgagcattgaataagttgatcttgcaggctgctataaggtttggaatagttcgatgcaaaagaatggatggcatcgatacggttgccggaattggtcgtggggtaattaagttgtcagcggggaaagtctgggcaatttgggccgaagctggcaatgtagatataggtgaggtgcttggagtgcgtgatatttcgtacggtgcaacattccatggctgaaatgctgaggtgtgcaaggtgagcgcggagttaaggaagatttttgaaaaagattgcaggaagttctcacggaacaggtcagtgagagcggggctaaggtgtcaaagggaaattcttgtcggtcgagagagtgtgggtagcgggcgaattggattcagattcctgaagaatgcaaatggctacattctttctgtcgccgccgattctcctgatcttcaggatttttaaaaaaataatccaccatataagtcgaggatacctacggggttggtgctcgcgatgaatacatccatggagagagtgaagtcattttctccgagttccggtggtgcagttgacttgccgcggaacgagatggaagtcgagtcgacatgtcgatggatatgcgaaaaagtgacaggtatttatttgccgagggtcataaatgcgatggaggttggggttggattgattcgggatgtaatggaaaatccaagctattattcctatccatttttgactgttgtgtttgcggcgaaaagcaatggtgtcgaattgagtgggctggatgttgattatttattgggaagtaaggtgtcgggaagtaagccgtttgatgagggtgttctaaaaaatattgtagataattgtatgcgtgagcgatctgagatcgggcgaggcagcgttgctttccttattttccgagctcgtatgggttttgttgatttcttatcgattgaaatttcgagtcgaatgaaaataggcggagtgatctattcatgaaaagagagtattttcactctaggacggattttatgtgtggtttcggagagatttttacggaatttgtcaatggtgttgctacacgccagatcagtcgtcctgatagtggaagggtctacgcgtcttcatccctacaggattggaggctgagccagcgagaactgtgacggcgtagtgctcgtgccgtcggcgcgtgatctcgaggatggtgatctagcttctttttggggagtgctctgttgattcggctcgaacagtactatgctggcgacgatgtctggaaaaatttctccgatctctttgcgaaattcaagaattttccggaagtccgggatctcgccaaggctttaaatgagcaacttgatcttgcttacacgatctactgggttgccggcccgaagtcggcccagaagtggataagttcgaacgtcccggcactcgacaacatccgccccatcgattgcactgacgacccggagttgatcaagcgcctgcgcgaatgtctaatgcggatgccatcgtaacgatcacggcaaccgctatgcgcgtacgcgttagaggaagggaggcgtaggctcaccgcctgccggtagcggctatacgtggcgcgcggccaaggtcgaaccgtttccaaccgtcacgttctgattgatcgagtcaggaaaggctgcgctagcatcgattcgctcctaattggcttcaaagcgtgcaataaaccgagaactgaccaagtcacgcgcctatctcaatggctaacgtacatcctaataggcgtcgacaatggtctaataggcaatgtccaactgatgatgtttgcgtgcacatcgtacgcgcgaatggacgtgccacatgcgtcgattttcctatcgatgcaccgtttccaccgaacaccaacaaaggaggaatccgaaccatcaaaatcgccgtagtaaacgagcgcaggccgcaagtgctaccaacactcacgcctcgctaaccgcggcccactaagtgggcgttgcccatggctaagccgaatcataacgcacgcccaccgaagacggaacgtttcgtcacgatccaggaaatgtggggttccccgaaaagaatggaccccaggccggaaaagttctagccgtacataaagatcggtggaatatggctgatcaacgacgcgtgttttgtcccgcgccgcaaaggacaagtcctgatcgagcccggcagcctgatcatcacgcagttataaaggcaacgccgcaggatgcggccgcgctgcgcgaactcgcgcagcgcgctggccagggctgctgctaccagccgccccgacgcatcaccaagcgatattgcaagacgaccgcgacgtcctcgcaccgccggtagccgtgcaatgcgtcccggcgccgttgtcatagaacgtccgcgtctccggctgcggcacggacggatcgaacggattcggcgcaccatgcggcccgcgcggcgcgtcgtatggccgctgcgccgcatacgattcgccactacccgccggccgtgagccattcgcccgcaggtattcattccagttctgctcacgctgctcgtatccgggcaccgcgcggccaaaactatcgctgccacccgccccgagcgcgactcgattcgcgggcaataccaaatcgggttcgtgttcagacgaaggcggcggtgccacaagcgcatcgcctgttacacgcaacggacgcgtatccggcgtatcgaacggactgcgctccacgggcgcggcgtactgcgagcggcggcggttcatgcgtgccgtatgtccatcgtcgcgaatggcagcgcgccgttcggaacgaaagacattggcaccggccgaccgatcggtcagcgtatcgcggccggacgcattggcggcggaaacagagagcgcgcacgcgatcgcggcggcggaggaaaggcgaaacggatgattcatgagcgatcccaatcaggtgatgtgcaatgaaaaaaacggcagatcactggctggcggctgggcgacgggcgggcgttgaagtggccctgaagcgactgcgaggcgcggtggacgcgtctcgcaggaaggctggctggattgcagaggcgaattcgtattatttcacatcaataacaataacctttccaagtggagaaaatcgttggcaaatagaaggcttgagcgcctccacccaacgcactgcaatggtgcccgcccaaccaatcatcagtcgattgaagaatgacgattcgaccctctacggtcccgccacgcaccacgaaaaatcgcctataacccgatcccaatcccgacaaggcacagcgccgaaaaatcccgccaatagcaaccagattgcactcccagcccccgccccagcgccccgaggttgcgccgtcattgctaccgactgtcacaacctctctacgtgttttcctcggtagaccggcatttttgacagacgatttaaaaacgcccatataatttcgactgccttgccaacggctgtcggaccaccctccgatcaagcggtttggcaagcggggcaggcgaaacgcttgcgcaatgcaagacgcatcacgatgtctttccgaaccagacgtccccttcggggactgcaagagccgggccccgctacgcaacattccgctggagttccgtcttctatgtgtctcgggcgtgtcccatgtcctcgccccgggtgctgttcgattgcgcaagtcatgccgcctttgcccgtatgactaaacaacatcgaggagctcccagatgacgctgtcccgtcttacgtccatttccgtcgccgccgtgctgttcgccgccggcgcggccaccgcgcaagcggaaaccgtgaagatcgccatcgctggtccgatgagcggctcggtcgcccaatacggcgacatggtgaaggccggcgcgctgaccgcgatcgagcaggtcaacgcagcaggcggtgcgggcggcaacaagttcgaagtggtgatgatggacgacgcatgcgaaccgaagcaggccgtcgccgtcgccaacaagatcgtcagccagaagatcaagtacgtgatcggtcacgtgtgctcggggtcgacgatcccggcctccgacatctacgagaacgaaggcatcgtgatggtcacgccgtcggccaccgcaccgcagctgacggaaggcaagaagcgtcacttcatcttccgcacgatcggccgtgacgaccagcaaggcccggccgccgcgcacttcatcatcaacaacgtgaagccgaagaaggtcgcggtgctgcacgacaagcagtcgtacggccagggcatcgcgtcgtcggtgaagaaggacctcgaagccgcgaagatcccggtcgtgctgttcgaaggcatcaacgccggcgattcggactactcggcgatcatcacgaagctgaagtcgcaaggcgtcgatttcgtctacttcggcggctaccacccggaaatgggcctgctgctgcgccaggcgcgcgagcagggcgtgaaggccacgttcatggggcctgaaggcgtgggcaacaaggacgtgacggcgatcgccggcccggcctcggaaggcatgctcgtcacgctgccggccgacttctcggccgatccggccaacgcggcgctcgtgaaggcgttcgcggacaagaagcgcgatccgaacggcccgttccagatgccgtcgtacgccgcggtgaagatcatcgccgacgcgatcgccggcgcgaagacgaccgacccgaccaaggtcgccgcgtacatgcacaagacgacgttcgacacgccgatcggcaaggtcgcgtatgacgcgcagggcgacctgaaggcgttcaagttcgtcgtgtacacgtggcacaaggacgcgacgaagaccgccgccaagtaatacggagtacccgcccacgcatccgccctgtccgaaacccggacggggcgggtgtgcatcgcgccgcgcatgtccccagtgcgcggccggcaggcggcccgagacgacaccgtgcgttgcgcgcggccgaatgccgtgatccggcgcggtacgcgacacagcgccaacgggagcttccgcacatgactgacttctttccgcaattcgcccagcagctggtcaacggcctgacgctgggtgcgatctatgcgttgatcgccatcggctattcgatggtctacggcatcatcggcatgatcaacttcgcccacggcgagatctacatgatcggcgcgtacgtgggcctcgtcaccctcacggccatcggcatctccgccggttatccgctgccgctcgtgctcggcgccgcactgatcgtgtcggtgatcgtcaccgggctgtacggtttcgcggtcgagcgcgtcgcgtatcggccgctgcgcggcggcccgcgcctcgtgccgctgatctccgcgatcggcatgtcgatcttcctgcagaactacgtgcagatcggccagggcgcgcgcgacgtgtcggtaccggtgctgatctccggcgcgttcgacatccatctcggcggcgacttcgacgtgacgatcccgtatgcgcgcctgctgatcgtctgcgtgacggtcgtgctgatgatcgcgctcacgctgttcatctcgcattcgcggatgggccgtgcctgccgcgcttgcgcggaggacatgaagatggcgaacctgctcggcatcgacacgaaccgcgtgatctcgttcacgttcgtgctcggcgcgatgctggcggccgtcggcggcgtgctgatcgggctgacgatcggcaagctgaatccgtatatcggcttcgtcgcgggcatcaaggcgttcacggccgcggtgctcggcgggatcggcagcatcccgggcgcgatgctcggcggtgtgctgctgggcctcgctgaaaccttcgccgcaggctacatgccggccgagtacaaggacgtcgttgcgttcggcctgctcgtgctgatcctgctcttccgcccgaccggcctgctcggcaagtcggacatcgaaaaggtttgagggagacgcagatgagtacagtcatttccgttcgccgcccggccgccgacgcttcgatcggccaggcgctgaaaaatgccgtggccgccgcgttcctgacggcgatcctcacgattccggtgctcgggctgcaactgaagctcgacggctatcaggtggtgctcacgccgcactggcggccggtgtggatcgcggtcgcggccgtgttcctgttccagttgttcaagccgtggctcgtgcgcgcgaaatcggcggtgaagctgcctgcgatgcccgcaatgggcgcgcggcagcagcgcgcggtcgtatgggtgctgctcgcggtcgggctcgtgtggccgttcttcggctcgcgcggcgcggtggacgttgcgacgctcgcgctgatctacgtgatcctcggcctcgggctgaacatcgtggtcggtttcgcggggctgctggatctcggctacgtcgggttctacgcggtcggcggctacacgtacgcgatgctgaaccagtacttcgggctgtcgttctgggagtgcctgccgctcgccgcgatcgcggccgcgacgttcggcttcctgctcggcttcccggtgctgcggctgcgcggcgactatctcgcgatcgtcacgctcggcttcggcgaaatcatccgcctgctcgcgaacaacctgacgagcctcacgggcggcccggacggcatctcgggcatcccgaagccgaccgtgttcggctacgagatggcgcgcagcgcgagcgtcgagggtgcgaagacgttccacgaactgatcgggctggaatacagcggcgaccacgtggtgatcttcctgtacctgctcgcgctcgtgctggtcggcttcacgctgttcgtcacgagccgcctgatccgcatgccgatgggccgtgcgtgggaagcgctgcgtgacgacgagatcgcgtgccgttcgctgggcctgaacccgacgcgcatcaagctgtcggcgttcacgctcggcgcggcgttcgcgggcatcggcggcgcgttcttcgcggcgcgccagggcctcgtgaatcctgaatcgttcaccttcatcgaatcggcgctgatcctcgcgatcgtcgtgctcggcgggatgggttcgcagctcggcgtgattctcgcggcgatcctgctgaccgtgctgccggaagtcgcgcgcggcttcgccgagtaccggatgctgatcttcggtctggtgatggtgttgatgatgatgtggcgtccgcagggcctgctgcccgcgagccgcccccacgtggagctgccgcaatgagcgcacatgcagaactgttgaaggtcgccgggctgcagatgcgcttcggcgggttgctcgcggtggacgggatcgatttcgacgtgcgccgcgatgaagtgttcgcgatcatcgggccgaatggcgcgggcaagaccacggtgttcaactgcgtcggcggcttctacaagccgaccggcggcgacgtcgtgctcgacggccacgcgatcgcggggctgccgagccacaagatcgcgttgaagggcctcgtgcggacgttccagaacattcgcctgttcaagtcgctgaccgtcgtcgagaacctgctcgtcgcgcagcaccgcaaggtgaaggcggggttgctgccgggcctcttctcgacgcccgcgtatcgccgcgccgagaaggaagcgctcgagcgcgcggcggtgtggctcgaccggatggggctgacgtcggtcgccaaccggccggccggcacgctgtcgtacgggcatcagcggcgcctggagattgcgcgctgcatgatcaccgagccgcgcctgctgatgctcgacgagccggcggccggcctcaacccgcaggagaaggtcgaactgcagcacctgatcgacaagctgcgccgcgagttcggcgtgtcggtgctgctgatcgaacacgacatgagcctcgtgatgggcgtgtccgaccgcatcctcgtgatggagcacggccgcccgatcgtgatcggcacgccggaagcggtccgcaacgacccgcgcgtgatcaaggcgtatctggggaagagtgatgctgaagctggaacaggtccatacgcactacggcgcggtcgaggcgctcgcgggcgtgtcgatcgaggtgaacaagggcgagatcgtcacgctgatcggcagcaacggcgccggcaagacgacgctgatgatgaccgtgtgcggcacgccgcgcgcatcgtcgggccgcgtgctgttcgagggcaacgacatcaccgcgatgtcgacgcaccagatcatgcggcaggggatggcgatctcgccggaagggcggcgcgtgttcccgagcctgacggtgctcgagaacctgaagatgggcggcttcttcgcgagccgtcatgagatcgacgacggcatcgagcacgtgttcaagctgtttccgcgcctgaaggagcgcgcgacgcagcgggccggcacgatgtcgggcggcgagcagcagatgctggcgatcggccgcgcgctgatgagcaagccgcgcctgctgctgctcgacgagccgacgctcggcctcgcgccgctcgtgatcgcgcagatcttcgacatcatccggacgatccgcgacgaaggcgtcacggtgttcctcgtcgagcagaacgcgaacaaggcgctcggcgtggccgatcgcggctacgtgctcgaaacggggcgcgtggtgctcgcggatacgggtgcgaacctgctcgcgaacgaccggatcaagcaggcgtacctcggcggttgacgccggaaagccgccggcctgcaacgggccggcggcgtttttgtcttcgctttctcatgcaaggccggttccggccttgtcttcacggtccgatcctgaacgtgcttttcagtacgtcgcgcagatgcagcgcggcgcgattgcggtcgtcggtcaggacggtgatcaggtgcggcgagaggtcgggcagcacgatcccggcgacgtggctcgtcaggttgccggacacgcgctcgtgttcgatgaggccgaccgcgaggccgttggcgatacaggcttcgaccgccggcgaactggcgctctcgagcagcaaccggtgcgcgatcttcgccttcttcagcgcgctcagcgcggtgtcgcggtacgggcagccctgcaattgcacggcgatcggcagcggcgcgtcgggattgaacttgaaggtccgcgcggccacccacaccggatgcgtcttgccgagcagctcgccgtgcggcggcgctttcggcacgacggcgatcgtgatgtccagctggccgcgggagaacagcgagagcagctcgtcgctggaacgcgcttcgaccgtcagctcgagcagcggccgatcggccgcgaagcggggcaggaattccgccatgaagtgcgcggcgtacgaatcgggaatgccgagccgcaacttgccggtcagcatctgcggcgacagcgattcgacgagccggtcgtggctcagcagaaactccgtggtgtcgctcagcagcttgtggccgaactgcgtgagttcgaccgcctggttgtttcgcgtgaacaggcgctgcgcgaccatttcctcgagcttctggatctgcgcggtgaccgacgacgggctgcgattcacctgggcggccgcatccttgaagcggcccagcttcgcgacggcgtggaaggtacgcagcaggtcgacgtccagggtgcggggcatgattttgaaattccgaatcagtgattcaggtaatgtcgattgacggaattattgggcctgcctattctcgggtcaaccgacaggccaaccggcagacaacggcaggcagccggtcgggcgttgcacgtatccggggaatgattcacgtcgatcaagaacccgcgcctgtccccggcaaccttccaagagccgtcgtcccatgcagctattcctgcttcagctcgttttcgtgttgtcgtggagttccggcttcatcggcgccaagctcggcgcggagacggccggcgcgttcaacctgctgttctggcggttcctgctcgtcacgctgtgcctggcgatcgttctcaaccggcagctcgggcgcctgacatgggagaagctgcgctatcacgcggtgatcggcttcctgtcgcagtttatctatctggcctgcgtatacgtcgcgatccagcacggcctgccgcccggcatcgccgcgatcgtcgccgcgttgcagccgctcatcacggcggcgatgacggcgctggaaggcagcgagcgcagcggggcgcgccagtgggtcggcctcgtcgtcgggttcgtcggcgtgggcatcgtgatcggcgggcaatatgcgctgccgaccggatcggtcgggctcgtcatgtacctgctgccgctggtgtccgcgtcggggctgtcgatcgcgacgatctaccagcggcgccgcgcgctgacggtcgcgcgcagcaacggggacgggttgttcctgccgctgttcgtgcaaggctgcgtgagcctggtgctgttcgcggcgagcgggattgtcacgggcgatctgcacgtgccgacccagccggacgtgtgggtgtccgtcgtgtggctgacggtttctcgaccttcgtggcctacctgtcgctgtgggcgctgctcaagcgcatgcccgcgacgcgcgtggcgaccctcgtttatctcgaaccgccggtgacgctgacttgggccgcgtggatgttcggcgacagcatcgcgatgtcgacttatctcggcatcgtcgtcgtcgcgatcggtgtgtggctggccggcaagccaggcgagcgggccacccgggcccggcgtaccgggatggaagcggccgggcgctgatgcgctggttgtgcacgcgattccggtgtagcgtcgcggtactgtcacgacctgtgaaggaatccgatgaaggtcaaacggatcgtcgccaatatcgaaacacgatcaatcgacgacgcaaagcgcttctaccagcggatcttcggcctcgacttgctgatggaccacggctggatcgcaacctatggcaatgccgagaagatggacgtgcagatcagcttcgcatcgcagggcggggcgggtacgccgacgcccgatctgtcgatcgaggtcgacgacgtcgacgaagcgctcgcacgcgtgcatgccgccgggattcccgtcgaatacggcccggctgacgagccttggggcgtgcggcggttttacgtgcgcgatccgttcggcaagctcgtcaacgtgctcgcgcatcgttgataggggatgcgggggcggccggggtgttcacgtatgcaacgccagccccttcacggccttgtcgaccgctttcttcggcccgcgcaacgccagcccgacgaggtcgggatgctcggcgtcgccggcacgaaagacttcgcggttggccgcgtcgtgtccggtagcactttgacgtgatggattgcatgctgatcgcgggatggatgtagccaatttcgctccgatcgtagtcaaattggctacatttcggtaatcggcctggatcggcacacaatcggcaactcggactatgccttgtagccaattgagctacaatcgtagccaatcatgctgcgatccattgcctcgaccctgtttggtgactatcgtcgccgcgcgctgggcctgctcctgttgcggcccgatcaggcgttgcacgtccgcgaaatcgcccgtttgacgggcacgacgcccggtacgctgcacaaggaactgagcaagctggccgaagccggcatcctgagccgggatcggcagggcaatcaggtgctctatcgtgccaatcgaagttgtccgatctacgaggaactggcttcgatcatgcgaaagacctcgggtatggctgatgtgctatccgaagcgctgttgccctgcgccgaggaaatccgtgtggcgttcgtgttcggttccgtcgcgcgcggccaggagacggcggacagtgacgtcgatgtgatggtgatcggctcggtcggctttgcaacggtggtccggctgttctacgatgcgcaggctacgttggggcgggacatcaatcccaaggtgctgtcggcggacgagtttcgtgagggcgtcgccgggcaggacgcatttttacgggacgtgcttggaaaacccaagattttcttgattggtagcgaccatgaccttgcagaacttgctcggcgttagtcttgatgcaatccggccggaccgggaacaagcgacgcgcctgctggctgcggcggaacgaaatctggcggatgcgcaaatcgcggcattgagtaacgaaaaccgctttgatgcggcgtacaaggcgatcatgcaactcgcgatgctggcgttgcacgcgaacggttttcgtacgttgacgagccggccggggcaccaccagacggcgatccagacgcttccacagacaatcggtttgccggtcgagcgcatgatcgtactggacgcgctgcgcaagcagcgcaacctgtccgattactccggggatgtggttcaggcgtcagcggttcgcgagtgtttcgatagtgcgacggcgctcctgattgacgtaaaggcgtggatcgacgggaacaagccggagttgctggccgcgcagtagccgttaccgtgtcgaatcgccaactcgaaacgccgatgcatcacgtatgcaatgccagccccttcacggccttgtcgaccgctttcttcggcccgcgcaacgccagcccgacgaggtcgggatgctccgcgtcgccagcacgaaagacttcgcggttggccgcgtcgtgtccggtcgaaaacatcgcgtgcacgtagggcacgatcgtgagttcgcgcgacagcgcctgccggtgcgcggcctgcaggccgttcaaatcggccgcgaacaccagcatcggctggcccagcatgcggccgtagcggcgtcccgccgcatcctcgtaaggctcgccgagcgcttcgggcgcttcagccgcgacgcccgtcgcgagaaacgcgacgacattgagtttctgccacgccgcgagatcgtcgcgcacgatcagcgccaccttggtatcgaacatgattgctcctcgttgaagcgcacatgatcggatgccgcgtgggatcagtctggaacgtttgtgcacatttgccggtacgcagccggcgtgatccgatatgcgcggcggaaccagcggccgaggtggctctggtcggcgaagccgacgtcggccgcgacttgtgcgggcgtgcggccggcggccagcaggcggcgcgcggcgcgtagccgcaagcgcaccaggtacgcgtgcggcgacgtgccgtacgcgcgctggaacagccgcgtcagccggaaccggtcgattccggtgagatcgacgagtgcgtcgaggccgatatcgtcgctcatgcgcgcatgcagcagatcgcgcgcgcgggcaatcgcgggcgcgacggcgttgccgccgctcgcgagcggggcgcgcaattctccgcccagccgcgtcagcaggcggtcgagcgcctggtcgcgtgcgagcttgccctcgttgccgtggagcgcgacgaacgcctgccggatcgtgtcgacgaggctgcgatcgtcgaccagcgtgtggccgaacgcggcttcgacgccgccgaggcccggcagatccagccggcgtgccgctcgctcgacccatgcctgcgggaggtacagcattccatacgtgaagccgcccgcttcgggcgcgtggccgtcgtgcagcgcgcccggctcgatcaggatcgcgcggcccggcacgctcgtatgcaccgaccggcggcactggaattgctgcacgccctgttcggtgaagccgaccagcatgtcgtcgtgatcgtgcgcatcgtatgcatggccgctgaaatgcgcatgcaggctttcgatgccggtgtctgcatcgcgcctagcgacgagccagtggtcgcgcgtgtcgctgccgttcgtcgccgtgtccatctccatcgctcgtttcgtgccgcgtcgtgacgtgtcctgcagtgtacgccgatgccgcccgctcacgcgtcgttcgccgccgcctgttcgtcccgcgcgtattgcgccggcggccgcccgacgtggcgcgtgaacgcgaccgtgaacgtgctcgccgaactgtagccgacgcgccccgcgatctcggcgatgcggccttcattgcgccggagcaggttcttcgcgagcgccatgcgccacgtgagcaggtattccatcggcgcgacgccgaccgcgcggttgaagcgttcgaagaaagtcgagcgcgacagtgccgcttccttcgcgagttcgacgaccgtccacggatgcgcggggcgttcgtgcatcccgcggcgcggccgcgagccggttgtcggccagcccgcgcatgaggccgggcgacgcgttcgtgtcggtcgtgaaccgcagcgcctcgatcagcagcacctccagcagccgcgccagcacgatttcacgcgcgggccgctgtgcgcgcgattcgtcgcgcaccagttgcacgagcgtggtcaaccgcggttcgccgcgcacatgcacgaattgcggcagcagcgacaccagcagtgccgcgtcgggtgaaccgaagctgcagttgccggccatcatccgcgtgtcgaccgggttgcccggatcgccgatccggtattcgccgttgtcgagcgcgaccggcggcgcggtttcgacgcccggcggcggcggttcgaggctcgacatcgcgacgccgtaggcggccggaatcagcacgaaatcgccgggcagcagttcgatcggcgcgtgcccgtcgatcgcgatccggcacccgccatcgaggatcgcgcaatagaacggctcgccggcgaccgtgcggctgatcgaccacgggctcgcaccgtgaacggacttggagtaccgcgcgcccggttgcagcagcgtcacgacttcggtcagtgggtcgatcattgtcggacgatcgcaaagaaaatcggatttccgattgtagcaaatacggatccggccatctatcgtacggacacatgcccaacacacctcaggagttcgcatgaagaccgtactgatcaccggctgttcctccggcttcggcctcgagatcgcccgccatttcctcgcacgcgactggcaggtcgtcgcgacgatgcgcacgccggacgcggccgtgctgccgccttcggcgcacctgcgcgtgctggcgctcgacgtgacgaacgcggacagcatccgtgccgcgatcgacgcggcgggcccgatcgacgtgctcgtcaacaacgcgggtttcggcgcggccgcgccggccgagctcatgccgttcgatacggtgcgtgcgctgttcgaaaccaacacgctcggcacgatcgcagtcacgcaggccgtgctgccgcagtttcgcgagcgcggggccggcgtggtcgtgaacgtcacgtcgagcgttacgctcaaggcgttgccgctggtcggcgcgtatcgcgcgagcaaggcggcggtcaatgcgtacaccgaatcgatggcggtcgaactcgaaccgttcggcgtgcgcgcgcatctggtgctgccgggtcgggcgcctgacacgcgtttcggcgacaacgcgcgcgcacatgcatggcttcgaacacgacgcgtatgcggagtttgtcgggaaggccgtcgcgcggatgctcgatgcatcggggccgatcacccatgcgcaggacgtcgccgaagccgtgtggcgcgcggcgaccgatccgtcgagcccgatgcgcattccggccggcgcggatgccgaagcgtgggcggccgaggcgcgttgatcgatcggaaattcgtcgcgccggtcggtcgagccggcgcgacggattgcgtggtgcggggaagggcgttaccgcgcaccgtcacaacgcccgttcgatcgcctgccccagcagcgccaggccgaggtcgatctcttcctcgctgacggtcagcggcggcgcgatccggaacacgccgcccatgcctggcaactgcacgatgttcatgctgagcccgaggttcatgcattcgcgcgtgatctttgcgccgagcccgtccgccggttccttcgtccggcgatccttgacgatctcgacaccgagcagcagcccgcgtccgcgcacgtcgccgatgcagtcgaaacgctccatcaggtcgagcaggccgcgccgcagacgctcgcccatcgtgttcgcgcgcgcgacgagcccgtcgcgctgaacgacgtccagcacgcgcaggccgacggccgccggcagcgggtcggacacgtgcgtcgtgtagaacaggtagccgagttcgtgcgcgcgttcctcgatcgccgcggacgtcaccatggccgcgagcggcagcccggcgccgagcgtcttcgacagcgtcaggatgtcgggcgtcacgccgtcgcgctggcacgcgaacatcgtgccggtgcgcccgacgcccgtctgcgcctcgtcgaggatcagcagcatcccgcgttcctcgcacttgcgcttgagcgccgccatatagccttccggcagctcgatgatcccgcccgaactgaggatcggctccgcgatgaacgcggcgaggttgccgctcgactggcggtcgatcaggtcgaacgcgtagtcgagttcggcgagatagtcgtacgtgccgttgcgctcgaagcgcggccggtaggtgaacggtgcgggaatcgcgaacgagccgacggcggccgggccgacgcccttgcggccggcgctgtacgtggccgatgcggcggcgcccgtcatcccgtgccacgactgcgcgaagccgacgatctcgtacttgccggtgacgagcttcgccatccggatcgccgcttcgttcgattccgcgccggtgctgagcagcagcgcgcgatcgagcccgtcgggcgtgatgtcggcgaggcgcgtcgcgaggtcgacgaccggccgcgacagcatcccgctgaacagatggtcgagcttgcccgcgtattcgccgatcacggagacgatctccggatggctgtggccgagcaccgcgctcatctggcccgacgtgaaatcgaggatcgcgcggccgtcggcgtcgtagacgaagctgcctttcgcgcgctcgatgatcatcggctcgaacgtgccgccgtagcggaccaggtgctgtctggcgttgcgccagaaggtcgggtcgtcgttcagggacatcgggcatctccgggcaaaagggcagggggcgcttgcagtctaggcgtgtgtctggtttgatggaaacgaatagttcttatgcaaggtagaaaaggagctaataccttggggctttcgcttgaaatcgacctgctgcgctcgttcgtcgtgatcgcggaggtgcgtgcgctcagccgcgcggccgcgcgtgtcggccgcacccagtccgcgctcagccagcagatgaagcggctcgaggaggccgtcgaccagccgctgttccagcgcaccgggcgcggcgtggtgctgacccatccgggcgagcggctgctcgtgcatgcgcagcgcatcctgcggttgcacgacgaggcgatggccgacctgtgcggcacggggttgtcggggacgatccgcttcgggtgcccggacgattacgcggaggtgtggctgccgtcgctgctgcggcagttttcgagccagcatccgcaggcgatcgtcgaggtcgtgtgcgggccgacgccgcggctcgtcgaacagctggagaaacgtgcggtcgacctggcgatgatttcattgccggacgacggcgcgaacgacgacatcattcgccgcgagcaactggtctggatcggctatccggggctggaacccgggcatttcgatccgctgccgcttgcgttgtccgatcgcgacacgctcgaccacatcgcggcctgcgaggcgctggagcgcgccggccgtcactaccgtgtcgcctacgcgagcagcagtctcgcggggctgatcgcgctggtgcgttcggggcaggcgttcgcggtgatgacgcagacggcggtaccggccgacctggcgatcgtcaccggcgatccgcgcctgccgccgttgcctgccgtgggcattacgctgaggttcgatcgcaagcggccgtcgcatctgacggcggcgttcgccgagcatatccggctcacgctgccgctgttgtgatgcgcgcggccgccgcgccgcggcgtcactcgaccgtcgacgaagccgacgcccgtgccgggtcatgcgcatccggtgccgcctccacccccacctccacatcacgcacgcggatcgccgcctgcatgcccgacaacttgagttcggtctcctgatattcgttgaccggctcggaatcggcgacgatgccgcagcccgcgaacagccggcaggccccgccgtcgaccagcgcggagcgcagcgcgacgatgaagtcgccgttgccgtgcgcgtcgatccagccgacgggcgccgcataccagccgcgatcgaatccttcatgcgcgcggatgtggtcgagcgccgcgtcgcgcggatggccggccaccgccggcgtcgggtgcagcgccgcgatgacctgcaagagcgtcgcgtccgccttcagcgtcgcgcggatcggcgtgctcaggtgctgcagcctcggcagccggtgcagcgacggttccggggcacgtcgagcacgcgcgacagcggcgtgagcgcggcgcggatcgcgtcgacgacgagcgcgtgttcgagccgctccttggcggaagccatcagggccgcgccgagtgcgcgatcgtcgtcgggcgtggcgccgcgccggatcgtcccggccagcgcatgcgtgcgcacgtcgccggccgcgacacgcgcgagccgttccggcgtggcgccgacgaagcaggcgccttcacggcggaccgcgaacaggtgcgcgtgcgcgtcgcgcttgcgcagccggcgcagcagcggcgcgatggcaacgggccgcgcgtattgttcgagcacgtcgcgcgcgagcacgaccttgccgaacgcgccgccgtggatcgcgtccaccgcgcgccggacttcgtgctgccattcgctcgcctgcagcgcctgcgtgtgcagcagatgcggtgcagcgtcgtcgcgggcggccgcgagcgtgccgagcgactcgatgcgcgcgagacacgcatgcgcgagcgcggccggatcgtcgtgcgcggcgacgacgtgctggcagacggcccagtgcgcgtcgccttcgcgcacgatcagcagcgtcgccaccgtcatgctggcgtcgggaaacggcgcccagtgcgcgctgcgcgcgccgcgcggatcgaaccggaagccgccgacggcgcgcggcggctgcgggccggccgtcacggcatcgcgaacgagcgtgcgccagcgcgcatcgatcagcgcgaagcgcgtgtcgccggcggcggtcagttcgagcgcactgtcccagccgaacagcgtgacggatgcatcgccggcttcgtggaagaaccacggcgtggccccgtcgtcccacgcggcgatcaggtcgaagaagtcgagcggccgcaccggcaccgacaccgacgcgagcgtcggcgtgccggtgtctgcggcgcggcgggccgcacgggcgaacgtgtcgtgcagcagcgggaggccggcgttcatgcgagccccgttgccggcgccagtgctgcgtctgctgcgcgatgtaccacgcgatcaggccggcgaacagcgtctcgacgtagtcgccgtcgaggcccgcctgttcggcccagcggcgccggtcgggcagcatcgcggccacgcgttccggcgcggcgatgctcgcttcgtcgggcttgaagcgcgatgcagccttcacgtattgcatgcgccggccgagcgcgtcgatgatgtcggcgtccaggcgatcgatggcttcgcgaatgtcgggcagccccgtgcaggcgtccggtgttttcatgtgtactcctttccgtaacgaagggattggtcgatccgttcgaccagatgcgcgatcagcgccgggtactggtgccgcaggtagaagtggtcgccgctgaacgtctcgatgcggatcgggcgcgacgcgacgtcctgccacgcgtgcgcttcgtcgtcgtcgagctcggaatcggcaagcggcagcatcacgccgagcggcgtgtcgagccgcggcggccggtcgcggcgatacgtctcgatcgcacggtagtcgtggcggatcatcggcaggtagatcgcgcgcatctccggatcggcgagcagcgcggcgtgctcgccggacagccgcgcgacatcggccacgagcgcgtcgtcggattgcaggtgcagatcggacaggcgctgacgatgcggcggcggcaacgcggatacggccaggtaaagcggggccgcgccgcgcgcttcgagccgcaccgccacctcgtaggcgagcgccgcgcctaggctgtgcccgaacagcacgagcggtgcgtgcgcatagcgttgcagcgcgtcggcggcggggccggcgagggcgtcgatcgtcgtcaggcacggttcgccgaagcgttcctcgcggcccggatactgcagcgcgagcaggtcgacgtcccatggcagcgcgcggctccagttgcgaaagaaattcgcggtgccgcctgcatgcgggaaacacacgagttgcgcgcgcgggcacggcgacaggcgcagctcgcggatccagttcgaaccggtcggtcgcgcgctcatgcggccgccgcctgcaactggcggcgcagcaggtcgcgcagcgatttcttgctggtcttgccgatgccggtttccgggaagcgcggcatgaactcgatgcgatcgggaatcttgaaggcggcgagcccgcagtcgcgcaggtagcgtttcagcaccagcctggacggcgcgggtgcgcgtgcgacgacgaacgcgcacgtgcgctcgccgagcagcgggtcgggcatcgcgaccaccgccgcgtcatgcacctgcgggtgcgcgagcagcaggttctccacttcctcggcggagaccttctcgccgccgcgattgatctggtccttgtcgcggccttcgacgacgaggtcgccgtcggcggtgcgccgcacgcggtcgccgctgcgatagaagccgtcggccgtgaacgcggctgcattgtgctcggcgagccggtagtagccgcgtatcgtgtacgggccgcgcacctgcaactcgccgatctcgccgggtgcgaccggttctccggcgtcgtcgacgatgcgcacttcgtcgccgtccgacacgggtcggccctgcgtatgcgcgatccgttcgggcgaatcgtcgagccgcgtgcagcagatgagcccttcggccatcccgaacacctgctgcagccggcagccgagcacgggcgtcacgcgcgcggccgcgtggtccatcaaccgcgcgccgccgacctgcagcacgcgcaggctcgacaggtcggcccggcgttgcggctgttcgtcgagccacagcagcgcgagcggcggcacgagcgcggtatgcgtgacgcgttcctgcgcgatcagcgcgaagctctgttcgggctcgggccgcccggtcgcgaccacgcggccgcccgcgagcagcgcaccgatcgtgccggggcagcacagcgtgaagttgtgcgccatcggcagcgcggcgaggtagacggtgccggcgtcgaatccgctcgcgacgctgcacgcacgcacgttgtacaggtattcgcggtggcggcgcgggatcagcttcggcgtgccggtcgtaccgcccgacagctggaagcatgcgatgtcgtcggcgcgtgccgcgcattcgcgcagcggcggcgcgtcgtacagcccgtcgaatggtgtgaacgcgtgatcgtcgccgtccatcacgacgtgctcgagcgtcgggcagtcggcctgcaacgcggccgcgagcggccggcagtcgaactcgccgagttgtgccgcgcacagatacgcgcgcgcgccggcgaagcggcagaacgcgccgatctcgtagtgccggtgggcaggcagcgcgagcaccggccgcaccccgagctggaacagcgcgaagcaggtttcgatgaagcgtgcgccgttcggcagatggacgacgaccgcgtcgccgcgcgccaggcccagacgcgcgaggccgcccgcaagctggcggatgcgcgccagcaggtcgcgatagctgagccggcaggtgtcgtcaacgaccgcgagcgcgtcggggcgcgctgcgcttgcgcgtcgagcgcctcgaagaacgtcgtgtcctgccagtagccggcgtcgcgatagcggtgcgcgaagtcgtcgggccagtcgggcgcgtcggccgggatggccggcgccacggaggaaagggaagagtgcatgcgctgaccttgggttccggcaagttgtcaaaaatgtaaatgagaggtattatcatttgtaacaagtgccgcgataacgtcgtttctttcgatatcgcggcaatttcattcgatcgggcgcctgtcgcgcggcgcccgcccggcccggccggagaatcggccggttgccgccggcgcgcgccgggccgcgcgtgccgcctaaccaacggacctccgatgagctcgacctccttcgcttcgtcacgacgtcacccgccggtgctcgtgcccggcaatcatccgggcgtggtgcacatcgacgcgggcatgaaactcatgagcggcacgctgtgctcggacagccgcgactggtacgaggagccgctcgaaaaagggctgaagctcgtcctcgtgcagagcgggcagttgcgctgtcgcgtgccgggccagcccgagcagtgcatcaaggggccgggcctgtgcgtgatcgccaacgacggcgaattcacgacgcaccagatctacgaccgcgacgtgccgctgcgctacacgatcgtgcagctcggcctcgatgcgctcgaccgcaacctgagcctgttgccggagaagatgctcgcgccgacgggcggcgatccgcgcatcgtcagttgcccggcatcgaaggcgctgcaggcgctcgcggtacagatcgcgacgtgcccgttcgagggcgcggtgcgcgagtactacctgaaggccaaggcattcgagctgaccgcgctgagtgcgcagttgctggcgacgcagcggcagttcgcgccggccgacgtgcgcgtcacgtcgtcggacgtcgagcgcgtgtacgcggcgagcgacatcctcacgcgcgagctccagcagccgccgacgctcgatgcgctcgcgggccgggtggggatgaattcgcgcaagctgacggccggcttccgcaaggtgttcggcacgagcgtgtatgcgtacctgcaggaataccggctgcggaccgcgcacgcgatgctgtgcgcggaggacgcgaacgtgtcgaccgtggcgtaccgcgtcggctacagccccgcgcatttctcgatcgcgttccgcaagcgctacggcatttcgccgagcgacattcgcgcatcgtcgaacgcgatcgacgatgccgaactggagagcgcggcaatctaaaacaactgaccggccgcctaaagcaatcgaccgggctcatgggcatgaatgagatagattctcattcacgggtggccgccgccgcgcggatccgccatcgaacgacccatacaaggcgtgcccatgagccagaccgctgtcgattcaaccatcgatcattccgatccttcctgtttttctcccattgcctttcgctcgcagctcgtcgcgatgatcgcggcgctgctcgacgagcccgtcgacgaaatcgcgtcgctcgacgatgacgaggacctgctgagctgcggcctcgattcgatccggctgatgtatctgcagacgcgcgtgaaccggctcggctacgcgctgacgttcgatgcgctcgcgcgtacgccgacgctcggcgcgtgggccgagctgctcgcgaatgcgccgcgcggcgcatccgcggcgcccgacgtcgaggccgccgagggggcgacgtcgacgtgcatgcgccgttcgacctgtccgcggtgcagcaggcgtactggctcggccgcggcgacggtgaagtgctcggcaacgtgagctgccacgcattcctcgagtttcgcagccgcgcgatcgatcccgttcgtctcgacgcggcgtgccgactcgtgcgcgaacgccatccgatgctgcgtgcgcgctttgccggcggccgccagcagatcgtagcggcacccgaggcgccggtgttcgcgcatgcggactggcgcgaccggacgcccgccgaagctgaaaccgaatgggtgtcgctgcgcgcgttccggtcgcacgaatgtctcgacgtcgagcacgcgcaggtcttcatgatgggcctcgcgcagatgcccggcggcgaggatcgcgtgtggctgagcgtcgacctgctcgcggccgacgtggacagcgtgcggctgctgatgcaggagatcggtgccgcgtatgccgagccgtcggcgttgcccgacgcgccgtcgacgtggttcccgacctggctcgcgcgtcgcgcggccgatacgcgcgatgcgcgtgccgcggcgcgcgacgcatggcaggcgcggctcgcgacactgccggaagggccggcgctgccgctcgcccgtgcgccggaaacgatccgcgcgccgcgtttcagccgcgtcacgcatacgctgagcacggccgaactgacgcgcctgcaggcgcgggccgcgcagcatggcgtcacgctgtcgtcggtgttcggtgcggcgttcgcggcggtgctcgcgcgctggagcggccgacaggcgttcctgctcaacgtgccgttgttcgaccggcacggcgatgcgcccgatctcggccgcgtgatcgccgatttcacgacgctgctgctcgtcgaatgcgacatgcgcgccgacgcgagcgcggccgacacggtgcgcgcgttccagcagcggctgcacggcgcgatcgcgcaggctgcgtatccggcgctcgacgtgctgcgcgatgcacgcaggcagggcgcgccgcgcgcggcgcccgtcgtgttctcgtgcaatctcggcgatgcgccgttcgtgcccgacgcattcgcgcgcgtgttcggcgatctgcacgacatgatttcgcagacgccgcaggtgtggctcgatcaccagctctatcgcgtgccggacggcgcgttgctcgcatgggacagcgtcgacggcctgtttcccgacgggatggtcgatgcgatgttcggcgcgtatgtcgcgctcgtgcaggcgctgtgcgatcgcgactggcggctgccgatcacggtcgagctgccgtccgcgcagcgacgcgtgcgcgatgcgctcaacgcggtgcccgctcccgcgcggccgcgcacgctgcatgccgacttctttgcatcggccgcgcgcgagccggcggccgtcgcattgcggtgcgccgagcgcgtggtgacgcgcggcgaactggccgcgcaggcgctggcgatcgcgggtggcctgcgtgccgccggcatcggtcacggcgatgccgtcgagatcagtctgccgcgcgggccggaacaggtggccgcggtgttcggcgtactggccgccggcgcgtgctacgtgccgctcgacattgcgcagccggtcgcgcgcaagacgctgatcgaacgcgcggccggcgtgaaggccgcgatcggcgacacggcgcacgcggatgcgccgctgccgcgcttcgatgttgcatcgctgatgaaacatgcgccgctggccgcgccgctcgcggtggcgccgcaggccaccgcgtacgtgatctacacgtccggttcgacgggcgtgccgaagggtgtcgagatgacgcacgcggcggcgctcaacacgatcgacgcgatcgatgcactgctcggcgtgcgtgcgcaagaccggctgctcgcggtatcggcgctcgatttcgacctgtcggtgtacgacctgttcggcgtgctcggtgccggcgccgagctcgtgctgccgacccaggacgacgcgcgcgacgcggcgcgctggatcgacctgatcgcgcagcatcgcgtgacgctgtggaattcggcgcccgcgctgctcgaaatggcgctggcggtgcccgctgcggccgacgcatgccgcagcgtgcgcgcggcgctgctgtccggcgactggatcgcgctcgacctgccggcgcgcctgcgcgaacggtgcggcgacgcgtgtgcgttccatgcgctcggcggcgcgaccgaggccggcatctggtcgaacgtgcagacggtgcgcgacgtgccgccgcactggcgttcgattccgtatggccggccgttgccgggcaggcctatcgcgtcgtcgatgccgacggccgcgatgtgccggattacgtgccgggcgaactgctgatcggcggcgacagtctcgcgcgcggctaccgcaacgatcccgagctgaccgcgcagcgcttcgtgcagcacgcgtcgggccgctggtaccgcacgggcgaccgtggccgctactggcccgacggcacgcttgaattcctgggacgcgaggatcgccaggtgaagatacgcgggcaccggatcgaactgggcgagatcgaggctgcgctggccgcgcatccgcagatcgacggtgcgtgcgcgagcgtcgtgaatggcgaagttgcgcgcatcgtcgccgcgttcgtgccggccgattgcgttgccgcttgcgttgccgatgccgcgccgtcgtcgctcgcggaggccgacctggccgatacggttgaggcggaagcggccgttgcgcgcgccgtcgccgatcggctgctcgatggcggcgcgggcttgccgccgtcgttgcgtgcgcaccggcacgcgaaaggcgatgcgtcgatctccatcgacggcgcgctcgatcggctcgactggtatgcaaccgatcttgacgatctgacggcgtcgctgcgcgcgctcgcagccgatccggataccgccgcgcagcgcgtaccgctggacccgtgcgtggcaccgcttgcgttcgcgacgcgtttgccggacggcgcccgcgtgctgcgcgagtttgccggcgcgctggaggcacaggccgctgcgcgcgcgggtgtgctgcgggtcgcggtggtcgacgcccgcgccgggcaatggttcgaagcgggcctcggcgtgctcgacgatccacgtttcgacgtgacgctgttcgacgtgtcgccggggctgctgcacaccgcacaggcacgcttcacacgtacgaggcccgcgcttcaggcgatgcaggacggcttgttgcccgcgcggcatctcggcgaattcgattgcgtgatcagtttcgcggccgcgcatctgcgcgacgatccgcgcgatacgttccggatcgcggcagcgttgctggcgcaggatggccgcctgctgttcgccgacgtgctgcgcgactcgccgctgcgtgaactcgtcgcgagcgtggcgggtgatgcgtcgttgcctcggccgttcacgcccgatgcgatcgccgccgccgcgcatgcgtgcggttttgcgctcgactcccgaagctggcgttcgaccgcattcgcgtgcatcgacgcgcgccgtaccggcgaaccggccgcgcaagcggcgctggccgactggctgcgcgaccgcttgcccgacgcgatgcgccccgacgcgctgtggtgcatcgcgcgctggccgctcaacgcgaacggcaagatcgaccggcgggcggtgggcgaggcgctcgcgcgcgctcggcgacgcaccggccgcccacgatgcattcgtgccggccgacgaacggcaggcgacgctgctcgcgtgctgggagcacgcgctcggccgcccggcgaacgcgcgcgacgcgacgttcttcgcgctcggcggcgacagcctgctcgcgacgcgcctgctcgcgcaactgcgcgagcggctcggcgtgcgggtcgggatggcggcgttctaccggcagccgacgctcgcgggtctcgccgcgcagctcgacgaggccgcactggccgcgccggccctgcaagcctcgcaggccgccggcgacacgccggttgcgacgatcgaggagggcgtgctgtgagcttcgatgacgtgctcgatctttgccgcgaacgccagatcgaactgtggtgcgacgacggcggccagttgcgctatcgcgcgccggccggtgcgctcgatgcggacctcgccgcgcgcatcaaggccgaacgcgacgcgttcgtccgcttcctgcaggacggcgcatggcgctgcgatccggtgcgccggcacgagcggttcgcactgacgccggtgcaggccgcgtacgtgctcggccgccacgagtcgttcgagttcggcggcaatgcgtgccatctgtacgtcgaatacggcgagcccgcgaatctcgactgcgtgcgcttcgaggcggcgtggaacgcgtgcgtcgcgcggcatccgatgctgcgcgcgatcgtcgaggacaacgcatggcaacgcgtgctgcccgacgtgccgtggcagccgctcacggtgcacgacctgcgcgatgccgatgcgaatgcattcgacgcgcacgtgaagcgcgtgcgcgagcgtctcgaccatgcggtgcacgcgctcgaccactggccggtgctgcagccggaagtgagcctcgggccggacggtgcggtgctgcacctgtcggtcgatttcacgctgatcgattatgcgagcctgcaattgctgctcgccgaatggcggcgccgctacgacgacccgcagtggcagcccgagccgctcgacgcgacgttccgcgactacgtcgtcaatgaagcccatgccggcacgcgcgcggatcatgcgcgcgacaaggcgtggtggcttgcgcgcatcgacgatctgccgccgcgccccgatctgccggtggtgcccgcgatgccgtccggcgcacggccgcgcttcacgcaccggcatgcgcggctcgatcgtgcgcaatgggccgcgctgagcggccacgcgagccgcttcggcttgagcgcggcgagtgtcgcgctggccgcgttcgccgaagtcgtcggccgctggagccagtcgcccgcgttctgcctgaacctgacggtgctgaaccggccgcccgtgcatccgcgcatcgacgcggtgctcggcgatttcaccgcgctgagcctgctcgcggtcgacgcgacgcacgggcgcgatttcgtcgagcgtgcccgcgcgatcggcgcgcggatgttcgacgacctcgaccatcgtgcgtttaccggtgtcgacgtgatgcgcgaactcgcgcgacggcgcggcaaggatgcggcgctgatgccggtggtgttcacgagcggcatcggcagtgtcggccggctgctcggcgagcacgcggcccgcgccgagccgccgcgctacatgatcagccagacgccgcaggtgtggctcgactgccaggtgaccgatcagttcggcggcctggaaatcggctgggacgtgcgcgacgacctgtttccggacgggatgcccgcggcgatgttcgacgcgtacgtcgccctgctgggccggctcgccgccgacgcggcgtggtggtcgcgcgcgggcgacatcgtgctgccgtccgctgcgcccgccgccgggatccatccggatgcggatacgcacatcgcggccggcttcgccgcgcaggcgttgcgtacgcccgatgcgccggtggtgatcgatgcgcaggggcgcgcacgtatcgcgacgtcgcgcagcacgcggcggcgctgcggtcggcgctcgaacaggccggcgtcgccgtgggcgataccgtcgcggtgctgatgccgaagtgtgcgcaccagctcgtggccgtgctcgcgatcgtccaggcgggcgccgcgtacgtgccggtcgacagccgccagccggcgctgcggcaacaggcgatcctgcgcaatgcgcgggtgcgtgcggtcgtcagcgtgcgggcgctcgagttcgaacacgacgggtgcgtgcgcatcgatgtcgatgcagtgccggtcgatccgcaatggccgccgcgcgccgcgcgcgacattcccggcgacgcactcgcgtacgtgatctatacgtcgggctccaccggcgagcccaagggcgtgatgctgagccacgcggccgtctgcaacacgctggccgacatcagcgcgcgccatgaagtcggcgacggcgacgtggtgctcggcctggccgagttgagcttcgacctgtccgtctacgacttcttcggcgcgaccgcgcgcggcgcgtgcatcgtgctgcccgatccggcgcgcggcaacgatccgtcgcattgggccgcgctgatggcgcgccatcgcgtgacgctgtggaattcggttcccgcgcaagggcagatgctgatcgactacctcgaaagcgaaccggcgctcgatgtgccgggcccgcgccgcgtgctgtggtcgggcgactggattccggtgacgctgcccacccgctggtggcggcgctggcccgacagcgcgctgttcagcctcggcggcgcgaccgaggcgtcgatctggtcgatcgagcatccgatccgtccggcggacacgcagctggccagcattccctacggccgcgcgctgaccgggcagacgatggaggtgctcgacgcgctcggccggccatgcccgccgggcgtgcgcggcgagatccatatcggcggcgtcgggctggcgacgggttacgcgaacgatcccgtgcgaacggccgaacgcttcatccgtcatggcgacgggcggcgactctatcgcaccggcgatctcggccgcgtgcgcgccgacggttcgctcgaattcctcgggcggcaggacgatcaggtgaagatccgcggctaccggatcgagctggccgagatcgacgcggcgctgaccgcgcatccgctcgtcggcgcggccgcgacgatcgtgctcggcgacggcacggagcgccggctcgcgagcttcgtctcgctgcacggcgctgagccgccgcagcaggacgacgcgctgcacgagatcgcggcgcacgtgcgcacggcgttcgacgccgcgcgctggcccgcgcatgcggacgtggcgcggtcggttgcccggctcgaagcggcctgcgttgcatcgctggcagcgtggatcgtgccggcagggcgctgaccgaggagcaggcgacggacttcgcgacgttgtgcgaacggttgcgcgtgccggcggcgcgacagcatctgctgcgtcactggctggcgatgctcgaccggcacggcgtgctgcacgcggatgccgaaggcggctggcgcaggcggcccgatgccggccatgccgatgcgcatgcctgctgggacgcatttgcgcaggatgcgtcgcccgatctgtggccggccgtcctcgtcgactacttccgcgacagcgcgggatgcatcgacgtacaggtggacggcaccgtgtcgcccgccggcctgatgtttccggaaggcgcatcgcatatcgccgacgcgatgtacagcgacggcgaacatgcgcgggcgctacatgacggaatggcacaggcggtgcgtgcgatcgtcgcgcgcgagccgcagcgcccttggcgcatcctcgagatcggcgcgggtacggccgcggcgacgcgggcgatcgtcgacgcgctcgcgccgctggtcgaagcgggcgcgcggatcgactacctgttcagcgacgtgtcgagctatttcctcgcggcggcgcgcgagcgcttcgccgcgtatccgtggatgcggttcgagcggttcgacatgaacgcggcgctcgacgcgcagggtattgcgccgcattcgatcgacatcacgatcagctccggcgcgctgaacaatgcccgcgacacggtcgcgctggttgccggattgcgcgcgctgtcggcggccgatgcgtggtgggtgatccaggaactgacgaccgagcatccggagatcagcatcagccagggttgatgatggaaacgccgcacgacgcgcgcgtcgaatcggcgcgtctgttcgtgccgcgcgcgcagtggctcgaatggctgcaagaggcgggcggcgatcgcgcgctcggttgcgtggcacccggcacgccgctcgacgcgctcggctacgacattctgctcgcgcacgtgaagcgcggcgcggcgcgcatcgcgccggacgcgctgctggcatgcgtcgcggagcgcgtgccgggctacatggtgccgtcgcaattgcgcgtgctcgaccgcctgcccgtgaccgcgaacggcaagatcgatcgccgcacgctggccggcatcgccgacatccgcgaaccggagccggcggccgcccggccggctcacgcgcaggccgctgccgatccgctgctggcacggctgatcggcttgtgggaagccgtgctcgatacgcgcaacgtcacgcccgatcaggacttcttcgccgcgggcggcgattcgctgctgatcgcgcaactcgtgtcgcggctgcgcggcgaggaaccgctcgcgcacgcgcatccgttcgaccggttgctgcgctgggtgctcgcgcaaccgacgcccgccgcgttcgcgcaatgcctgcgcgacgcggatgcgcagccgtcgggcagcgcatcgccgggtgcgccggccgccccgcgcagcgcgcacgtttcggcggtcgtccatgcgccggcgccgcgcgtgcgtgccggcgtgcggccgatcccgctcgcgcccggcgacggcgtgccgcgcgtgatcgtgcatgaagggctcggcaccgtgcatgcgtatcgcccggtcatgccggcgctcgcgcggctcggcccggtgctcggcttcgcggtgcgcgacgcgcaggactatctcgacctgccggcgcgccacctgaacgcgacgctcggccggcgttatgcggatgcgctgtggcgcaccggcgtgcgcgaggtcgacgtgctcggctactgctcgggcgggctggtcgcgctcgaaatggcgaagtcgctggtgcagctcggcgtcgaggtgcgcacgctcgacatcgtgtcgagctaccggattccgtacgtgatcgaagacgagcggctcgtgctgttcaacttcgcggcgacgctcgggctgccgctcgacgcgctcgggtttccggaaacgtacgtgctggccgacgcactcgccgacgcattgaaggccgacccgcgcgtctcgcgcccggcagcctgcaggcccagctggagattttcggcgaccgctgcgagccgctcgacacgttgcgccgccgcgtgctgcgcgcggccgccggattgtcgatgcaggacgagatcgcgcacccgctgctcgacgagcgcgaacggctgtaccggcttttcatgcattcggtgcaggcgagccactgggcgggcgacgcgccgtacgcgggtgcgctgcggctgttcgtgccggagcgctgcaacccgctgattccgcaacagcgcgcggcgctcaccgaatactggacggcacaggcgctcggcggcattacgtccgtcgacatccccggcggtcatttcgactgcctgaacgccgcgttcgtcgacacccgcctgaaggaggcgcaatgaaggctcatccgctgccggtcgtcgtggccggctcccgcttcggccagttctatgcggcgggcctcgccgcgtccggcacgtatcgcgtcgcaggcatcctggggcaaggcagcgcgcgtaccgccgcgctggccgcgcgcgtcggcgcacccgtgttcgaccgtccggaagcgttgcccgacgacgtgcgcgctgcgtgcgtcgcggtcggcggcgcggcgcgcggcgccgacggggccgcgctcgcgtgccggctgctcgggcgcgggatcgacgtcgtgatcgagcatccgctgctgcccgacgaatgggaccgcgtgctgcgcaccgcgtcgcgtcacggccggcgctgcctgctcaacagtttctatccgaacctgccggtcgtctcccgcttcatctccgtcgcgcgacggctgcgtgaaacgagcgcgcccgtgcatgcggatgtcgtgtgttcggtgcaggccagttacgcggcgctcgacgtgctcgccgccgcgctgcagggcgtgggcccgtggtcggtcgagccggtcggtccggcactgtcgtcgatgcgcgaatgcgcgatggtgctcgccgaaacgccggtctcgctgcgcgtgcacaacgagatggcggcggccgacgacggccggatgagcatgctgttcagcatcacgctgacgacggacgccggcacgtggacgctcgcgtcgccgcatggcccgctgtggtgggcgcccgcgctgcgcgaaccggcgacggacgacgacgggctgttcccgatcttcggcgacgcggcgggcgacgacatgccgagcatccagatctgcgacgaagcgcgcgatacgtggggcgcgattcatgcccgcagctggccgcaggcggccgtgcgcgcggtcgaccggctcgtgtcgggcgaagggctgcacgcgtgcaaccagcgcagcatcgacgtggcgcgcgtctggcagcaactgacgatgcagctcggttttccggagcagccgccgggcgacgcgtgcgcggccacgctcggcatgctgctggagcgtgccgcatgaaggggccgttgctttcgatgttgcggccgttcgcggcgccgcttgcggcggcggtcgtgctcaggcgctggcgggtgtcgcgtcgctcgtgccgtggctcgcgctcggccgtatcgccgacgcatggcgcgcgacggcacagctcgacgcgacggcgcgcggctggctcgtcgcggccgtggggccggcgtgtgctggctgggcggccagacggtcgcgctgcacctgacgcaccgtgtcgacgccgatctcgccgaccgcttgcgcaggcggctcgccgatcatctgcaacgcttgccgctcggctggttcgcgcgcgcgggtagcgaccgcgtcgcgcgtcacgtcgatcaggacgtgcgcgcactgcaccaactcgtcgcgcacgcgccggccgacgtcacgcaactcgtcgtcgtgccatgcgcggcgctggcgtgcctgctttacctgaatcccgggctgctcgcctttgcgctggccccgctcgtcgcgggcgccgcgctgttccgctggatgcgctcggcgcggttcgtaccggccgtcgcggcgcgcaacgcggcactcgaacagctgatgggcgattacgcgcagctcgcgcagaacccggcgctcgtgcggcagtatccgggcgccggcatcgaggcggccgcgctcgcgtcgaccgggcgcttcgaccaggcgttttcggcgtgggtcggccgcgtcggcgggcccggtgcctgcacgcaggtgctgctcggcacgccgttcctgctcgcgtgggtcgtgttcggcgcgacgtggctcacggccggccgcctgccggtcggcgaactgtgtgcgttcgcgctgctgatctgggcggttgccgcgccggtgcgggcgctcggccacggtgccgacgcgttgcgcgaagcgcgcgcggccgctgcgcgcctcgatgcgttgctcgcgcagccgggcctgcccgagccggccgacggcgcggcgcaggtgccgcgcgatgcgtcgatcgagctgtgcggcgtgagcgtcgacatcgacggcacgccgatcctgcgcgacattgacgcgacggtcgcggcgggcacgaccgccgcgatcgtcgggccgtcgggtgcgggcaagagcacgctgctgatgctgctcgcgcgcttcatggatcccgaccgcggcacggtacggctcggcggcgccgacctgcggctgctcgcgccggatacgcggcgcgagcaggtggcgatggtgttccagcaggccgccgcgctcgacgtgtcgatagccgcgaacatcgcgctttaccggcccgatgccgatcacgacgcgattcgcgcggccgcgcgcgcggcctgtctcgacgaacgcatcgatgcgttgccgggtggctacggctgcgtgtgcgggcgcgacgtgcggctgtccggcggcgaactgcagcggctggcgattgcgcgtgcgctgctgtcgacggcgccgctgttgctgctcgacgaaccggcatcggcactcgatccgcaaaccgcgcgtgcattgcgcaatgcgctgcgcggcgacgcgcgcacgcgcgtgatcgtcagccacgatctcgacgcgatccggcaggcggaccagattctcgtgatggatcgcggccgcatcgtcgagcgcggcacgcatgcggcgctgctggccgcgtgcgggctgtatgcgcggctgtggcgcgaacgcggtgccgcggacggggaggccgcatgatgatgaaatcgctcaaacgtttgcagtgcctgccatccggcacacgccgcgcgctgtggcgcggggtcggctgggcgatggcggccgcgttgctcgacggcgcctgcgggttgctgctcgtgccgttgatccgcgcgtggttcgccggcgcgcaggcagccgtgttgcattggacgatcgcgctcggtgcgctgaccctgtgccatgcattcgtgctgtacgtcgcgcagcgcggcggctatcgcgcgggcggcgcgctcgcggccggtctcgtcgaacgcctcgtgcggcacctgccgcgtatcgcgtcgtggcagaccgtgcgcgacagtcatccggccgggttgctgcgcgggccggtcatgcaggcgatggggattccggcgcacctgctcgggccgctgatcggcgcggtcgtgacgccgcttgcggtcgtcgccgggctcgcgtggatcgactggcgcatcgcgccagcctcgcggcagccgccgtgttgctgttcgggctgctcgagcgcggcggcacgcgcacccttgcgttcgagcaggcgcgcgcgtccggcgatcgcgacatggccgtgcagcttcagaccttcgccgcgcatcaggggctgctgcgcttcgcgggccgggaaggcgacgcgcgcgcggcgctgcagcacgcgttcgacgcgcagcatcgccgcacgcgcgctgatgcgccgctcgctgccgatcgaactcggcttcgcgggcgcggtgcagggcgtgttcgtcgcgatgctggccggcggcgcatgggccgtctcggcgggccggctcgatgccgcgacggccgtggcggtgctcgtgctgctcgtgcgtttcatcgaaccgctcgcgcagctcacgcagctcgaccaggcgttgcgcggcgcctggcgtgcgctcgacaccgtgctcgcggtgctgcatgcgccgcgtttcgacagccccgaccgcggcacgccggtacacgacgcgagtgtcgacgcggtgcgcgtcggctaccgttcgcccgccggcgcgacgctgctggacggcgtcgacctgcattgcccggcgggcggtttcgtcgcgatcgtcggccccacgggtgccggcaagagcacgctgctcggcctgctcgcgcggctcgacgatccgggcgccgggcgcgtgctgctcggccgcgccgatgtgcggcacctgagcgaggcgacactcgcggcgacgcgcaacctcgtgttccaggacaacgggctgtttcgcggcagcctcgcgtggaacgtgcggatgggccgcccggatgcgaccgatgccgaactgcgcgacgcgctcgacgcggtcggcctgctgcgcgacgccgagcgcttgccggacgggctcgaatccgacgtggggccgggcggccagttgctgtcgggcgggcagcgccagcgggcgtgcctggcgcgcgctgctgtcgcgtgcgccggtgctgatgttcgacgagccgaccgcgagcctcgacgaatcgagtgcgcggcgcgtgcgcgacagcctcgtcgcgctgcgcgggcagcgcacgcgcatcgtcgtcacgcaccagccggcgctcgcggcggccgccgacacgatcgtcgtgctcgatgcgggccgcgtacgggcgaccggcacgcacgcgcagcttgtccaggccgacgcgtggtacgcgactttcgcccgcgccgggcagctgccagacggcctcgcaccggccgaaacgatcgcggaagcccggccggccgaatccgaacactgacgtgaacaatgcgggccggcgtgcccggaatcgataggaaaagccctcgatcgaaaaatggcctgccggttctatttgataatgagaatgattatcaaatacgggggcgtgaatgcggtacgaggtgctggaacctgggagatcgatgacgaagggcgcgcgcgtcgcccgtttggggcgagggcgctggcgcccgtcgctgtatctcggtctgctgatcgccgcgcatccggcggcggcgtttgccgatgcggcgccggcggccggtgcggaagtccggaaggaggaaacgaccgccgtgaagcctgccgcgggcgagctgaaggcgatttccgtgaccgggtcgcgcggcgtggccgacgatccggccgtggcgacggtcggcaagatgccgctggcgttgcgggagattccgcagtcggtcagcgtgacgacgcgcgaacggatcgaccagcagaacctgtattcgctcgacgaggtgatgcagcaatcggcgggcgtgaccgtgcagccgtacgtgctgctcaccaccgcgtatttcgtgcgcggcttcaaggtcgattcgttcgaattcgacggcgtgccggtggtgatcggcgacatggcgagcgcgccgcaggacatctccgtgtacgaacgcgtggagatcctgcgcggcgcgaacggcctgctgcacggctcgggcaacccggccgcgacggtcaacctcgtgcgcaagcggccgcagtaccagttctccgcgaacgcgagcgtgagcgtcggcagctgggaccgctaccgcgcggaagccgacatcggcggcccgctcaatgcggccggcaccgtgcgcagccggctcgtcgccgcatacgaggatcgtcatttcttctacgaccacgcgaaacaggacacgcgctcgatctacggcatcacggaagtcgacgtgacgcgcgacacgctgctcacgttcggcgcgcagtaccagacgacgcgctcggtgcccgacatgtccggcgtgccgatggcgcgcgacgggtcgagcctcggcctgtcgcgctcgacgttcctcgacacggcgtggggccacttcgactgggacacgacgcgcgcgttcgcgtcggtcgagcagaagctcggcgccggctggaaggcgaaggtcagcggcgaataccagagcgtgcgctccgacctgaaatacgcgggctcgtacggcgcgatcgatccgtcgaccggtgcgggcggcgcgctgacgggcggcgcgtaccggttcagcagctacagccgcagcatcgatgcgaacgtgcagggcccggtgcatgcgttcgggctgacgcacgacctgctgttcggcgtgacctacgcgaacagcagcagcgggcagatgtcggcgcagctgctcggcaacgtggccggcatgccggtgaacgtctaccgctggaacccgagcagcgtgcccgagccgggcgtcggcccgtaccagcagtcgcagcagaacgacgtgtcgcagaagggcgtgtacgggctcggccgcatcaagctcgcggaacccgtcacgctcgtgctcggcggccggatgagctggtggaaccaggacagcctcggcgcgcactacaacaccggccaccagttcacgccgtacggcgggctgatctgggatttcgcgcgcgactggtcgtggtacgcgagctatgcggaagtgtttcagccgcaaaccaaatcgatgtggggcggcggcatcctgacgccggtgaaggggcgcacctacgagacgggcgtgaagggcgaactggcgggcggcaagctgaacgtgtcgctcgcggcgttccgcatcgatctcgacaacaatccgcaggtcgatctcgcgcatccatgtgccgggccgaactgctactacgtgaacggcggcagcgtgcgcagccagggcttcgagttcgaggcgaacggccgcatcacgccgtggtggagcgtgtgggcgagctatacgtacgacacgatgcgctatgcggacaacctcgcgaacgcgggcacgttcgcgccgctgctgaacccgcgccacctgttccggctgtggaccaactacgacctgccgtggcaggaacggcgctggagcgtcggcggcggcgtgcaggtgcagagcaattactcggcgcaggcgaacggcgtcacgatgagccagggcggctacgcgttcgccagcgtgcggctcggctatcgctacgacaagcactggagcgcggccgtcaacgtgaacaacctgttcgaccgcaagtactacctgagcctgagccagccgggctggaacaaccgctacggggagccacgcaacgtgatgctgaccgtgcgcgggcagttctgatggcgggcggctggggacgcgggcggcgctcgcgatcgcaggcgtgctgccgggcgcggtcgcgctggcggtcacgctggcccgtcattacccggccgacggcctgaaccggctctacgcggcggtgctgctgtcgctggccgcgggtgtcgccgcgctgctgtgggtgctcgtcgcgcccgggcggcggcaggccgcgtggcgcgcctgcctgtggctcgcggtgctcgtgccgtgcgcgatgttctgggagggcgctgacatggacgcttcatcgcgttcgcgctggcgcgcgctgcatcgcggcgccggtgcgctgttcggcgtggtgctgttcgtcgtgctgttcagcggcacgtggagtctcgcgaccgattcgatgcagggctggtggcggccgcctccggtcgccgtcgcgcggccggcactgccgctcgatacgctcgtcgcgcgcgcggcggcgctcggcgtgccgttgcgcgatgcgcgcatcgtgctgccgcaaccggacgatccggcgatccgtttctgcgacgcacgccaggcctgcacgctggcgctcgacccggcgacgggcgagcggctggccgacggcggacgcgcggccttgctcgtcacgctgcacaagacactgttcgcgggctttcccgggcggatcttcgtcagcctgtggggatcgtgctgctcgtgctcatcgtcgcgggcctggtcgtgcatcaccggcgctggcctgctgccgcgcgcatccggcgcggcagcgggctgcgcgccgcgctgttcgacctgcacgcgtggatcggcctgtggggctcgccgtggctcgtgctgttcgcgttcaccggcgcgttgtcggggctgggcgcgctcggcacggtgtcgcttgcgggcgtcgcatatccggggcaaccgcagcgcgcattcgccgagctgctcggcgggccgccgccgactgccgccggcggcgcgtggcaacgcgcgcccgatctcgaggcgctgctgcggcgcgatgcggcgcgtacgccggatttccggcgcgaagccgtcgtgttgcatcggtggggcgacgtgaacgcgcgtgtcgagattgccgggacgaccgccggcctgccgagcacggcgctgttcgagcgtcacctgtatcgcgcggtggacgggcaatggctcgcggacgccacgtcgcgcggccgaggcttctggttgcgcgcgttcatcgcggtgcagccgctgcatttcgcgcaatacggctgggtcggtgcgatgggcggcgtgctgcgcgtgctgcatttcctgatgggactcgcggcgtgcgcgctctgcgcgacggggctgcatctgtggatcgagcggcggcgggtgcagcacgaccgctcggcgaacgtgctggctgcggtcgccgtcggcgcctgcggcgggctggtgctggcgggcggcgtcctgctgctcgcggggcgtgcgctgcccgccggcgtgcacgtcgaccatgtgctcgcgatgctgttctgggccgtggggcggcgcgttcgcgctcgcggcctgcgttgccgatcgcgcggcctggctgcgcacgctgatgcgtgcggccggcgccgcttacgggctggcaggtgcgacgcattgcgcgatcgcgctgcttggcgcgggcgaacccgtgtactggccgatcgacgcggccctcgtcgcgttcggcgcattgctgctgcgtgccgcgcgccgtccgcgccgcgatgcgatgcggcccgcgcgcgtgccggccggtgccgaaccttttaatttcatgcaactggagacttcgatgcgcgatctgctcgaacatcgccgcctggtcatcacgatcacgctgctttacctgtcacagggaatcccgatcggcatcgcgatggatgcgatgccgaccctgctgcgccacgacggcgcaccgcttcatgcactggcgttcctgccgctcgtcggtttgccgtgggtcgtgaagttcctgtgggcgcccgtcgtcgacaaccgctggtcgccgcgcatcggccggcggcgcagctggatgctgccgatgcagacgctcgtggtgctctgcctcggcagcctcgcgcagatcgggatgaccgtcgcgacggccggatgggcggtcggcctgctggccgtcgcgtcgcttgcgagcgcgacccaggacatcgcgaacgacgggatggccgccgagcacttcagcggcgacacgctcgcgaagatcaacgcgatccagatcgcgggcgtgatgatcggcttcttcggcggcggcgccggcacgttgacgctgatcggcctgttcggccagcgggccgcgtttctcgcgctggcggccgtgccgctcgcgagcctggtttgcgtgctgtgggtgttgccgcgcgatgcggatcgtgcgcgcgcgaagcccgagcatgatgcgagcctcgtccgtttcgcgaagcggccgcgctcgtggtcgctgctgtcgctcgcgctgctgtcggcgatgacggccgtatcgggcttcggcctgtcgaagctgttcctcaacgacgcgggctggacgctcgacgcgatcggcaagctcggcatggccggcggcatcgtgacggtcgtgctcggttgcggcggcggcgcgtggctcgtgaggcggctcgggttgtggcgtgcgttcacggccggcgtgagctgtgcgggcgcggccgcgctgctgtggttcgcgcaggcgggcgggtggctgccggtgtcgccgtcgtgggcatggctgtgcacggtactcggttcgctggcgaccgggatcacgtcggtgtcgatcatgacggccggcatgcgcttcgcgggcggcagcgaccaggccggcaccgacgtgacggccgtgcagagcacgcgcgacctcggcgagctgatcgcgtcgtcgacgattctgtcgctcaccgcgaaggtcggttatacgggcgggtttctcacgggcgccgcgctggcggtgctcgcggcgctgatcgcgatgcggctgaagcggcgcgagtcggcgtatgcggtgaaggggatgatgcgctggcgtgacgccgcagtactggcgtcggcgcaacgcgtaggcgcgacgaagatcgggctgacgggtaacgagcagtacgtgcagtagcggagtgaaggcggcgggtgccggaatgtgtttccggtgcaggccgggaatgctccgtcaccgggagccggcaggctgcacggcgtgcgtcgagaggccaacgtgtgggccgccgattccatcggcatccgtgagaacgtgattcgttcgctggggatgatcgtctggtccgggtattcgcctggctttctccaccctttgcaccgcactgcgttttgaactggaatcgatataaatcgcggaaaaggtgccgcgacgcatactcaggattgctcgcagtcgcggtagcgtgtgatgaacggcaggatcaaggtcggacggatacgcatcggtgcgatatgcgccgcatgcaaaggcatcaaatatgtcccacgcaaaaagcgatagatcaaggtttgccagtcgaaccagtcgcttcagaaatgcgaagctgacggcaaggtcgaatctgccgttgaggaagagccacgcgatgtcgtgagccaactcatcaacgatatcgcgggaggctcgaaatccggaggcctcgtcggtctcgatgcaatgttccgccgagcgtcgcgccgtttgacatccacgaatggccttgtgcatgaatgatccgattctgtcggggcagtggaattgccgtcggagtgacggggaacggcttgtcgtactgcaggagacgccgggagtctccccggcgaaacgtcgtcatgctcgtggcgcacggcctgattgttcagccgcgatcgatcggaatttttcaaaaacgagaatatttaacgaaattccttcgtcgggtgacggcataaaatgggccgcctgggtatcgatcattgagggctgaatcgaacgccacatcgtgatgtgcggatgagtcgttcaaggcgaggcgcggtttcggctatcgggaaggatgggggcgaccgtatatcgatcgtattgacatgactggttcgacgacgactttccgcccattcgtgccgttttcagtgggcctgcgcactcacgtggcgttttccgggagcggcggcgggttaccgcggccggttgccgtgacggaacgggaatgagtccgctgtcgtcgctgctgcgcgttgcgcgcgcgccggccgtgtgggcgccggagtacgcgcgtgccgcccggatcgaatggggtggggcgcaggtcaccgtgcgcgatgtgcggaacttcagatatcgcacacgcgacgactgcatgccggcgtactacgacgcaacgttcgcgctcgaatcggtgacgacggtcgaccttgtcgtgtcgcgctggaccaacgaagcgattgcccacgcgttcctgagtttcggcctgagcggcggccgttatatcgcgatctcgatcgagacgcgccggcggcacgggcagcgctactcgccgtacaagggtttcttgccgctgtacgacctcgtatacgtcgttgccgacgagcgcgatttgatcggcgttcgcaccgatgtgcgccgggaacgcgtgtacttgttccgtgcgcgcgtcgcgtccgagaccgcacgtgcattgtttgaggattacctgcggcgcgtacatgcgctcgaacgccatccggagttctacaacacgttgctcaacaattgcacgacgaatattttgcaccacgtcagatcggttgcccctgacgtcggatacagctggaaggtgttgctgagtggttatgcggaccgatacggacatgagctcggcctgctcgacgattccataccgttcgatgcgctgaagtcggcaagcctgattcagcgcgctcccggcgcgatgatcgatggcgatttctcggcggcgatccgcgcatcgctaccgctcgcacggaacaaatgaacccatgtctggccaccggcctgcgacgactcgcgcgcaccgtggccggcgacgacgaggagcggaacatggtgagactggtcatgctgttgctgggcgtggactatctgcgcaagcgcgcgaaaggaattgtctggatcggcatcgtatgggtcatcgcggggctcgtcgtgttcgtcgatgcgctcgacggcgcaatgcactttccggtcacgctctttgcgtggttgtgcctgctcgaagggggcgacgctggccgtcgcatggaccggcgtcggcgggcaacgcgcattgcgctacgtgaaggagtcgcggtcgtggccgcgtcgatgctgatctttgccggacaccatcacgggaacctgatcctgtcgatgattttcggcgcgttgttcctggtcgacggggcactgcagtgcgtatccgcgtggatcgtccggtatcgtcgctggaggatcgcactcggttgggggcagtcgagatcctgatcgcggtgttttctttcaaccgtacccgacccactacgtgggcacgttgccgtactgccttggcctgttcctgatcttcggcggcacgaacatgctggcgctggcggcccgcgtgcggcgtctcgaacgcaatccggcattcagcgtgtcacgctggtctgcattgtttcccgacgtcgcatcggaggcacgcacgagcccgttcgatcgaaccgaatgggacggcccgccggccgatcacgagcgtgcgctgaccgtgcatgtgtggacgccgacgggttcgtcgaaggcgccggcacagcatcatccggtggtcgaccgctacatcgccgcggtcgacgtcaacggcaacatttcgaccgggcatgcggcgctcgagtcgcccgagggaatctacatcagcctgtatcccgccgccgaaatcgaccgttcgccatcggagttcggccgtatcctgcgcgcaacgcgcgaaaacgacgtgcccggcacgtttcaaccggactatgcaacggagtcgcgcgcgtggtgtccttccacgatacgcgtgcggatccgcaattacgatccggcgaagttgcgcgcgttctgggagcgttaccggatcgatacgacgtacaacctcactcaccgtaactgctcgagcaccgttgcctatgcgctcgaggcggcgatcgacggtgcggtgggccgactgcacggcggcagtacggggtggggcagttttctgcgagtgctcgtcacgcccgaactgtgggttgccgcgcagattcgcaagcgtgcggtgacgatggcgtggacgccgggcctcgcgctcgactatgcgcgtgcactgagcatgctggccgatccgcgtccgttcgcgtggtggaaggcagcaggggttgccgcaagccggctgtcgcaacagcgacgtgcatggcgtgcgcaggacgcgggcaccgcgcaatgatgcggcatacggattgcgctccggccacgcctgggaaaaacataaggattccgccgaaatgcgcgcgactcgcgatgttcgaatggcgtggtgccgtgacggcggtgcgatgcgatttatcggctgtcgtcgtcgcctgccggtacgtgacccgacagtcgaagttgacgcggcgtgacgccgtagtaccgcttgatctgcgtcgtcagatagctctggctgccgaacccgcaatcgagcgcgatcgacaggatgctcgtcgacgtatggcacagcagccagcgtgcgcgttccaggcggcgttcgatcacgtactgcatcggtgtacgtgagaatcgctccttgaacgccgcgattgtcgcgtgctcgctcaggccggtgtatcgggcgatgtcggcaaggctgatcgatttgccgagcgaggcatcgatccagcgattgatggacgtttcatagaggatgtccggacgctcgcggatgtttcgactgacgtcctgagcgctcggatttcgacggtacgttgcgctcggtggctctccgaatcgccggtggtacaggcgaacgaagcgcaacgacggcgcaaagccgtatgcacgcagcacgccgacaaaaccggtgccgatatcgacggccagcgcgcggtgaacggcgcgaagacgtgcatcgaggatgatgtccctcgaatgtttgccggtcaggcgccggatgccgttttccagcgtgttcgttgcacatcccagcgcataggcaaccgtactgagcgttgcccagcgtgtcgggtcggcttcgatcgtcgcaaccgcggtacgcgcgaggtgttcgggcgcgtggcgatcgctcaggacgacgtcgctgtagttgttcttgtggccggtcacgacgagcttgagcatgtgctcgtacagcgagcgtatcgcgatatcaggggatggcgacatcagcatcattcgacgcaggcaatccgcggacgcgttccattgcgtggcgagatctttggccagcggcgacaggtcgaactggatgagttcgtcgagcgggtggccgagccagtgtccgacaaactcgttgacctcggtgacatcgaggatcacggcaatgtggtgcagcccctcgggtcgtgacaggcacgttgcgtcgctcgcggacgaaacaggcatcacatcgccgatggcgcattgcgcgaccgaattcccgctcgagtaagtcgatccgccgttgatgcacgacgagaagagatagttggggcgggggccgcccgactgaaaatgaaacggtatttcgaaattgccatcgtaaaccgcgagcccgttccattgctggccactgacagtgacgtcccgattgctggcgtgacatgcacgaaagcggttctccgtataggtcgccacgagaaaatcggaaacctcatccgggtcattactgtgaaagcgatgcgtttggattggcgattcactcatcatgatggccagttcgaatgtttttcttgattgaatattaatggggtcaatcagtgtcgggagcaatgcggtttccggccgacatcgtagggaaaagccggtcgctcgataagctgccgcgctgtatacgggtatatgaccggttacgccgactatgcatacggaacctgcgtgtggtgaaacaaggtgaccgggcagaaatgaaaaatgaaggcccgaacaccttacacccggatgcttatttttagagaaattccgtcgatattccggaataaataatcttacagagtcaatacaatcgtgtgaccgatgcggtttatatcggacacgtttccctcgggaaatcctgaattattcgattgcgaatcgtgcggcgttacgcggcgcaactgggtgaaaccggttcttgcatccgcgtgacagaggggcatgcctgtcgataaatgcgggcgcacgtgcgtgacaccgtctgaagaatacaagcgatgaaaattctctataccaactttcatggcggaaatggtggtgggcatgacacctatatctatcaccttgcggctggtctgggccgtcggtatcgcgtcgcggtcgcatcgccggccggcagtcgcctgtcgcgcatggtcgatacgctaccgggcgtgcgcatcgtcgacatgcagttcaagccgtgttggcgcacatttctccccgagttggtgcggctgcggcgcctgatccagcaatccgcgttcgacatcatccacgtcaacggctcggccgatcaccggcaggtcatgctcgcactcgtgggctgtcgcacgcgaccatcggtcgtttttacgaaacacaacacctatgcggccggcagcatcggtaattttgcgggcgcggttcgcgacggacacgacgatcgccgtcagtgactacgtccggctgatgctcgagcggcagtcaccgtacggcgacatcacggtaatcaagcatggcgtgcagttgccgccgcatacgggcgggcaggccgagatccggcgtcggcgaatcgggtatttcggcgaagccggtgcggacgccatcgtgctcggcagcgtcgccggcaccgggccgcacaaggggtggagcgatttggtcagcgcgcttgcgcaattgccggatgcattgcgcgcgaagtttcgcgtgctgcttgcaggcgactggccgtcgaaggagcagcgcgaattcgtcgcgcattgcggcgtggccgcgaacgtcgcgttcgtcggtccgacggatcggacgcatgacatcctcgcgatctgcgacgcatcgttcgtgctgtcatatcacgaaagcctgtcgtttgcgtgccgcgaagcgatgtcgatgggccgtgccgtgatcgtgaccgatgtcggcggcttgccggagaacgtcgacgaccggatcgacggctggatcgttccgccgcgatcgcccgaagcgatcgccgccgtcctgcgcgagattgccgaacatcccgaacgtgttcccgagatggggcgcgcgcgcgcaaggagcgaacgcgagttcagtttcgcgcggttcatcgacgaaacgagttcggtttaccgcgcgtcgatccgcgggacggcggtgtctgcatgaccggtgttccgacgcaaccgccggtcacgccgcaggagcggccgtcggcaaaacgcgccgcgtgcgtcccgattctgatgtatcaccagattcgcccgttgccgccgcattcggacgtattgcgcggcctgagcgtcgatccgcgcgcgtttcggcgccagatgcgtgtgctgaaggcgctgggctatcgcggcatgtcggtcaccgacttgcagcggcggctgccgcaggcgcggcgcgaagctgtttgccatcacgttcgacgacggttttcgcaacgtggccgagcatgcgctgcccgtgctcgatgcgctcggctttaccgcgacctgctacttcgtgtcgggcaggctgggtggcagcaatgattgggatcgcaggctcgcgacggccgagggcgcgttgatggatctcggcgcgctgcgcgaatggcacgcgcacgggcacgaggtcggcgcgcataccgtcgatcatgttgtgctgtccgacgtgccttcaccggctgcgtggcggcagatcgcgcattcgaaggcgcaactcgaggatgcggccggatgcccgatcgtgtcgttttgctatccgtatggtgcgctcgacgcgaacgtgcggcgacttgtcatcgaagccggcttccagaacgcgacgacgaccgtgcgcggacgtgctgatgcgcgtaccgatccgtttctgctgccgcgtattgccgtgccgggcgggcgtggcgtcgcgcgctttctcgggaggttcttccggtgatgcgcgacagatccgccgcaaacgccggacggctttgccgtgcgggcccgctgcatgcagggcgcggcacaccgtccggattcgacgcggattgggtcgcgcggccgatagtgcgcgtgctgctgttcgtcgcgctgggaatcgcgtatctggcgccgggcatcattggccacgacccgtggaaacaggacgaggcctacacgttcgggatcattcggcacatgctcgattccggcgactggattgtgccggccaacaccggtacgccgtttctcgagaagccgccgctgtacgactgggtcgcggtcgcgttcgcgcgcctgctcggcgcgatcttgccgttgcatgacgcggcgcggcttgcgagcgcattttcgcggcgctggcgttcggcttcaccgcgcgtgcggcgcgcgtggcaaccggctcgacacgctggttcgagctgggcgtgctcggtcccgtcgcgctgtgcgccgggacgctcgtggtgctcaaacactcgcacgacatgatgacggacgttgcgctgatggccggcgcggcgatcggtttctgcggtctgctcgaacttgtcgcggggctcttgcaaggcggccatgccgattactgggcggccgcgcggctgggcgtcggcatcgggatcgcgttcatgtcgaagggcctgttcgtgccgctcgtgttcggcgcgaccctcggtgtcgcgctcgtgctttatccggcgtgtcgcacgcgtgcctgcacgcgtgcgctcgcgatggctgcgctcgtctgcgcaccgttcgcgttgatctggccgacggcgctctatctgcgttcggaaacgctgttcgccgtctggttctgggacaacaacgtcggccgcttcttcggcttctcggtgccgatgctcggcgccgagaacgacaagctgcttttcatctggcgtgcattgctgacggtcgggtttccggttggtccgctcgcggtcgtggcgatcgccggtggtgtgttgcgcggctggcgcaatccgtcgatcgcgctgccggtcgcattcgccgcgatcgggctgatcgtgctccactttgccgcgacgtcgcggcaactctacgtcctgccgtttatcgggccgctgtcgctcatcgccgcgcgcagcgtcgagcgtatgccggctcgcgtgcatgtcgcgtgggattacgcgagtcgcggcctgttcggtgcatgtgcggtgctggtgtggtgcgtctggcttgcgatgacgcacgacacgctgccgcgcgacatcttcgggtggttgggggctggctgccgcttgactggacgattcctctgcaacccgcggcgatctgcgcggcgttcgcgctgagcgtcggctggctcgccgcgttgctgttgctgcgcggagcgggcccgtggcgtggtgcgttgtcttgggccagcggcgtggtgctcgcctggggccttgtctacacgctgttgctgccctggctcgacgtagcgaaaagttatcggtcggtgttcgacgacctgaagatccagcttgcacgcgagtggcgcgcgggcgattgcatcgcgagcccggggctcggcgaatccgaggcgccgatgctcgattacttcgccggactccgctacgtaccgatggacgagccgcgtgcgcgcgcgtgccgctggctcgtcgtacaaggcatgcgcggtgcggtgccggatccaggggcgtcatgggcgccgttctggcatggcgcgcgccccggcgatacgcgcgaggcactcgtcgtttatcgcgcggtgaacggtgagtggccgagtgccgggtcgaatttgccggagcgcagatgacgacgcgcagcggacgccgcggttgttggctcgcgatactggtgatcggcgcgttgatgttgctcgtcgcggaactgatcggaatcgttgcttcgctcgtcggtcaggtgtgggggcgaggcgtgatgcgaaggacaacggatgagtacatttcaggagaaaacaatgggaaagcgctggtgcatgacgtggaggcggatcggacggctgctcgcgggtttcgcgctggccggattgatgagcgcttgcggatcgggagacgattcgataacggcgacggccgagcgtacggtgctcgtttatcttgtcggttcggatttgacatcggaccttcaatccgatcttgacacgatgaccaaggccacggccggtacgaacgtgaatatcctggttacgaccggcggcggagaccaggtgcagaaggacgtcgactggactcggactcaacgttggcagctctcgcaggggcggcgaaccaggctggccgacctcggagggcaggacatggcggcatcggccacgctgagcgattttctcgaatggggtatccggcagtatccggcgaagcgggtcgcggtcattctgggcgatcacggggcggcccgaatggcggctttggttatcggacgacgacgaaggccgagcgcgatgcggggacctcccgcgtttgtcgttgcgggacatgacccaggcgtttcagcgcgcgaccgcggccacgggaaagcgcttcgatctggtcgggttcgacgcatgcctgatggccagtgtcgaggttgccgccgcgtttcgcccgtatgcggactatctggtcgcatccgaggatcttgaattcggcgggtgggattacgccagcgtattgggcggtctcgtcgcacagcctggtatgaatgcccgagacctgggaacgctgatcgtcaacagctatgccggcttgcgcgcgggagacaatccggatttcacggtttcgctcgtcgacctgggggcgctggacagtgtcatcggcgtggctgacgcactgggccgcgatctctatgccaacggaaacagcgtggaggacatcgcacgtgcacgcgtcaacgcgcgttcgttcgataccgactggacgagagtcaccgatatggtcgatctggtgcagttttcaagggcgctcgagcttgcggcgctgccgaggccgacggtcgcgagcagtgaggtcgaaaaagcgctgaatcaggccgtcgtcgtcaagcgggcgggaagcaaccggtcgctggcgaaaggattgacgattttcatgccggcaggcgctgcgtacgacaccgccgtcatgaagacatacgacagcctggatttcagtacgtcctaccggcgttttgtcggcgaatacggcgcggcattgcgggcggcgctcgatgtactcgtccagatctcgccgccagtcgcgaccggcgatgatgttcaggctttcgcgtattcccgaagctctggcaggaagaagtgccgatggctgcgcttgaagacagcgtcgggcaaatcgtggcagttcgtcctatcggaccggcgtcacctgccacggccggggatgcgaatttgggcggcgatttccgcaagctctcgaccaaattgtcggagccatggtacgcgctcaatggttgcatcgtgtcggtgattccgggcgtaactggcgataccgaaacatcgttcgtgatcccggtatcctaccgcgaggagacgtccaccacagaagtcaccggcttcttgctggcgtcgggagagccgggtggtgacatgactctgaaggggttcgtgccgttacttggcacggcagtcggtcatgtgacgccgatcggctcaacgtggacattgacgccgcagctttggagggctgacctgtcggcatggaccattcccgacccggagactgtcgtatgcaaggcggccgtggcgcaggacggaagctggaaaatcggaaggaccgggaagcccgactcgtatcgattccggttcgccgtagcagacctggcgaaccgcttgcgtctgtctcccgagatgtgacgaagaaccctgttcccctcggagaggcaggggcctggaacgtccggggcgcgctccggctcatgttcgatctttccgattcgctcgaagtactcgacccgaccggcagtgcgtgcaccgtgcagccagacgacctgccgggcttgccgcagtcgccggcaagccgttcggcgcgatgccggaagcggtagcgccggccgatcggggtgttgcggacgttgtttgggcattgctcgcgtgtgagcaacaacgcggtgaagcggcagaatgggccggcatcctgatcgatgcacgactatctcgatgcgtggcgtacttgaagcaggccacggggaccggatcgcgcgcgacccgcgccgcacccgtgatgtgcccattacgtacccactacgcccgtgccagccggcgcgcagccagcagcccgagcacgagcagcaccgcgacgtaagcggcgacgcccgtccacgcgccgtgttgccagaacgtgccgccgatcgacccgagcacgctcgacccgagatagtacgcaagcaggtacagcgacgcggcgtgccccttcgcggcccccgcgaggtagcccacccagccgctcgcgaccgagtgggcaatgaagaagccgatcgtcacgagcacgatgccgacgacgatcgcggcgagcgaatgcgacagcgtcagcgcgaggcccgccgcgaacacgagcacgccgctgacgagcaccggtgcgcgtccgagacggtcggcgagcgcgccggcgctcgatgacgacaccatcccgaacaggtaggcgccgaagatcagcccgcacgcggtcgcactcaggttgaacggggccgcggtgagccggaagcccgcatagttgtagatcgtcacgaacgcgcccatcaccaggaagccgatcgcgaacacgaacgggagccgcgcgtgacgcagttgctcgccccacagccggacgtgatggcgcagcgtcaggtcggtgcgcttcacgaagcgccgcgacggcggcagcagcatcacgaacgcggccgccgcgatcaggtcgacgacaccgatcgtcagcatcgccgtgcgccacgagaagtgctcttccagcatgctcatgccgatccgtccgaccatgccgccgaacgcggttccgccgacatagagccccatcgagaaaccgagcccttccgacgcgatttcctcggcgagatacgccatcgcgacagccgggacgccgcccagcgcgaaaccttccagcgcgcgccagaccagcagcaggttccagtcgggcgatagcgcggcgagcacgttgaagagcgcagcgagcgtcatcgacgcgaacatcagcccgcgccgcccgacgcgttcggacagcgcgccggcgcacagaatggagatcgcgagcatcccggtcgacagcgacagcgagagcgaactcgaggccgcgccgaggccgaactcgcgtgcgaacgcgggaagcagcggctggacgcagtacagcagcgagaacgtggaaaaaccggcaaggaagagcgccagagcgatgcgcttgtaggcggccgagcgcgggaaacgccggcgggcagcgcatcgggcgtggcctgttgcgtgccgggcagggcacgggaaagcgaaggggaggacatgactgcgctcgatgtgcgaaggaacgcctgaattcttgcgcacggtcatgtatatgtccaatatatgaaagtaaccgcagcgatatgtttaaccactggctggtgaacccacccggcacaccgtgagagcacgtacgaatggaactccggcatctccgttattttctggccgtggcggccgcgtcgaatttcaccaaggctgccgaggcgctcggcatcgggcagccgccgttgagccagcagatcaaggcgctcgaaagcgagctcgatgtggaactgttcaggcggaccgcgcgcggcgccgagctgacgctggcgggcgaggtcttcgcgcaggaagcgcgccgcgtgctcgacgccgccgagcgtgcggtgcgcgcggcaaggcgggccgcgcgcggggaaaccgggcatctgcgcgtgggtttcaccgggacggcggcgttcaattcgaaagtgtcggacctgatccggcgctttcgggaagcgtttccggatgccgagctgacgttgcaggaggccgcgtcgcggatgctgctggaggcgctggaggccgggcacctcgacgtcgcgatcgtgcggccggcacgccgggccgccgcgacgttgcggatgctcgactgggacgacgaaccgatgttcgtcgcgctgcccgttgcgcaccggctggcgcagcggcggcggatcgatctggtggagctggctgacgagtcgttcgtgcaggtgccgaggaggccggcggcgcgctgttcgaccatatcgtcgccgcatgcaatgccgccgggttcgagccgcgcatggcgcagcctgcgccgcaaatggcgtccgcggtgacgctggttgcggccgggctcggcgtgtcggtcgtgccgaaggcgattacgcaggtgcaggttgccggagtcgtctatcggccgttgtcggggatgcgttgcgggcgcggctcgccattgcgtcacgatgcgatgaatcgtcggcggtggtccggaattttctgttgctggcggggaggatggggcggcgtgagggccgcggaaacaaaaaccgcgaagccatgtgccgtcgcgtttttcgaacatgcttgaagagcgatgatgttgtattcgacgggatgttggccttcgcatttgaatgacttcaatatcgacgaagaagtaattttgttaattgtcgtgcgctgccgtctgcaatctgtcggtgttgatcgcgagatgaaaatgaaggatggattctggaattttcaatcgatgatcgtcgtgaccggttggggagcttgtcgatgagggattcactattcattcgctacgccaggcagaagagggttgcctgcttgcacatcgccagcccctatgatgccccgagggtgccgtgatcgtctacgatacgaccgatgaatcgactcgtggtcaggccgaggtcgtactgcccggaccgttgttcgcgagtgattacatcagtccgaatagcagggtgatgcgcaagggcgagaaacccacgttgatcggaaagggtagaaaggtaacgggagtctggatcaaatgaaatggaatgcctggtttttgatttctggcgcagtgctttcttgctgggggcgacagttctggccgatcaacgcaacgccgatccgttcgtcgcgtttcagcagcggttcggcggcaatcaggagttcgtttgcacggcaaagggagggaagaaactttccgtcaatgttggcgtgcctcaggcggatgccgatcagatgaaggtggtgccccgccaggagtggggcaataccctgtcggtctatctctccgctggcgagggaagccgattgattcgtcatggggaacgccggccttcgatcaatcgatgaagttcatgtcgatacggttgcggaacggcaagacgctcgttttcgagcgatttcgaaatatccccgatcccgatgcggatgaaaagcatctcgatcacaaaccgtacttcaatctgacgatcgatagcggagcaaagctgccttgcagtcaggtcttcaatttgtcctgacgcgtggccggtggaatcggattgcagggtcggcggccgcgtcatcggtacgcgaaacggtatgaatgccgcattgaagtcgaccggacatcggtcgtttgcttctctcggatcacggagtggggccgggccgtcagtaaagagtgacgcacagcgttcccgacagtgtccgatcgaatggacttcaagctggaaagggaacgtgcggttatcgatgtgggccatgctccgacaggtcttgtcggccggcaattggcacatgccgcgccaggcgggcgatgaggaaggaaccacgacgaaaacctcgttgcgaggcggctggatcgtcggaaccttgacgcaaggcggggactgctgaactcgaaatgcggttaaaccgcttctggtgccgacggcgagactcgaactcgcacagctttcgccactaccccctcaagatagcgtgtctaccaatttcaccacgtcggcactgcattgcactgcaaggggcgcaattgtagcgtcacatttcgcgtttgtgaagagggtgtgacacgatgggcggatgcgcgaaagcgatcccggtagaattcgggcgatcgacccgatggccgtcgcaaccgcaacccgttttctccgcgtgacacataccctcgaacaactgcaggccgggcaactggccggcgcacggcaactcaagctcgcatgcgggttgacggcctttccgcgcgagattttcgatctcgccgacacgctcgaagtgctcgacctgaccggcaatgcgctcaccgcgctgccggacgacctgccgcgcctgcatcgcctgcgcatcctgttcgcgtccggcaaccgcttcaccgcgttccccaacgtgctcggcgcgtgcgaacagctcgacatgatcggcttcaaggcgaaccggattcaaaccgtgccgcgtggatcgctgtcgcgcgcattgcgctggctgatcctcaccgacaacgcaatcgacgagttgcccgccgatatcggcgattgctcgcgcttgcaaagctgatgctcgccggcaaccggctgcgcatgctgccggccgggctggccgcctgccgcgcgctcgaactggtgcgcctgtcggcgaatcgcctggacgaactgccggactggctgctgcggatgccgcggctcgcgtggcttgctgccgccggcaatccgttcggtgcggcaccggaagccgcggcgtcggcggagccggatgtcgcggacgtcgattgggcatcgctcgcatgcgggcagaagctcggtgaaggcgcatcgggcgtgatttaccgcgcgcaatggacggcggataaccgtgcgccgcgcgcggtcgccgtcaagctgttcaagggcgcggtgacgagcgacggcctgcccgattgcgaaatggccgcatgcctgcatgccggccgccacccgaacatgatcccggtgatcggcaaggtgcgcgggcacccggacggcacgcacggtctcgtgatggaactcgtcgatcccgcgatgacgaatctcgcggggccgccgagcttcgcgacctgcacgcgcgacgtgtatgccgacagcacgggattcgagcctgccgcggcgctgcggatcgcgcacggcatcgcgtcggtcgcgggccatctgcacgaacgcggcatcatgcacggcgacctgtatgcgcacaacatcctgcacgacggcgccggtggcgcgttgctcggcgatttcggcgcggcgtcgctctacgacgtgagcgaccgcatgcgtggtgcgcggttcgaacggctcgaggtgcgcgcgttcggttacctgctcggcgagttgctcgatcgatgcgggcagcaggcgtgggccggccggcccacgctcgacgcactggcggcagcctgtttgaacgaggatgtcgacgcgcggccgtcgttcgtggagatcaccgccgcgctggctgcgcaaacacgctgacgggacggcgcggcaagttcggtctcggcaatacgagcgcttacgcctgccgcgcagtcagcagcttgatcccgagcccgacgaacagcagcccgctggcgcgcttgagcgcacgtactgcgcggctcatgccgaagccgcgatggaaccggcgcacgccggccgaatagatgctgtgaacgatcacgacggtgcacgcgatcgtcgcgtacatcacgacgaactgcagcgcgagcgggcggtcgtgcacgatgaactgcggcatgaacgccgacaggaagatcatcgtcttcgggttgctgcccgacacgaacagcgcttcgcggaacagcttcccgcggtcgggcgcggcgagctccgccgcgccggtcgacgcgccggccttgcgatcgccgcgcagttgcctgacgcccaggaccatcaggtacgcggcgccggccaccttcatcgcgacgaacagcggcggcatcgcggcgagcaccgcgccgacgccgagtgcgacgagcaccacgaccacgccctgcgcgacgagattgcccgcgatcgtcgcggccgtgccgtgcgtgccgtagcgcaccgtgttgcggatgacgagcagcacgttggggcccggcgacagcgtcgtggcgagataggctgcggcaaacagcatccaggtctgaaaggacatgcggcgctccgagaggcggttccggcgggcgggatgacgcgatgatgccacgccaatatatggcccgggcttgcccggaaccgtgccgtcgcggcgcgtcgcgtgcgtcgcgcatgcagtacgcggggatcgacggcggcgtatcgatcgcggcgggccgcgtcatccacgcgatccatccggcccatatcccgcagacgatcagcacggcgacgttcagcggcgtccggtagcggacgatcaggtcggccagcggcaggcggtgtttcatgtgcgtctccttcgatcgggggcgggcggcgttactggccggcgtaggtcggcgccttggcgtcgcaggtcacggataccgtcgagccgtccgcgaaacgcagccggaacggcaccttcgcgccgggcgcgacggcctggcgcggctgctccagcatcacgtgatagctcttcggcttgaaggtcaccgtgccgtgcgcgggcacttcgacggcgtcgacgtgaaccatcttcgcggtgctgccgttcgtttgcgtttcatgcagcatcgccattccgtatgcgggcgtgtcgaggcccgtcagcgtgacgggcgcgtcgccgtcgttcttcagcgtgaagtagccggacgacggcacggtcgccggcatcgcacggatccagcagttttctgcctgtacggccggcgcggcgaacgtggcgggagcctgcagcgcgagcagtgcgaacagcaggccggtcggaatcgggcgtttcatggttggttctcctgatgggtggatgcggcggctatcggcggcgacgcgctcggcacgaaacgccgatgcgcatcgcgaacgtcatttcagcgtgaacgcgtagtggccttgtgtgcgatggccatcgctggccaccgcgatccacgcgaccgtgtacgtgccggcggtcaggctggccagcgcgacgtgcatgcgtttccggttgcctgcgtcgacggacgatttccgtcggcgaccgactgcccgtggctgtcggtcacggcgatcgagctgaaagcgggctcgagcgcctcgctgaaaccgatcgagaccgtatgcggcgcggttgagagcgtggcgccggcggccggttcctgcgttttcgggagtgcgtgtgcgtgggcggcctggatcgcgacgaagccgagtgcggcgagcgtgccgcgaatgaaagtggcggttttcatggttgagtgtgcgagtggcgaatcggatgaagcaacacggattcgacggacggatgcacgcgtaccatcgcagcagcaccgatggcggcccacgccggcgcgaacgcgcgcggccgggcgcttgcccgcaggcgaatgccggcgcgacggtacgcaccggcagcaagcggccgcacgcacggtacgacgccgcgcgcaacacggtgagtcatgatcgtccttcgaaacgtgacacgtcgcgcacgccggcgacgtgcgcgagccgcgcgatgcgctacggcatcacgggcgttgacgacgaatcaggacgtgaacggagggcgcgcggttgcgcggccgtgagcggcagcgcgcggcgcaggctttcgaagcgggtcgcttcgcgatgctgaatgatgtgcacgttggccgcgaacgtcagttcgggcgcgggcagggcgggcgtatgggcgagcaggctgcaatagccgcatgcctggaggtgggcctgcaggctctttcgcgacgcatcggcggagtgctcgccggtggccggcgcggccgtgcagtagccggccagcagcgtatcgacgcgctgctgcgtcgtcagggcctgcgagatcgtcggtgcgagcgccgtcatcaggatggcgagcatcccgatcagactgccgatcttccggagacgacgactcagcatgcgatgcgcggcggcgtaggggcgacgatggagcggattatgccacgcacgtcgattcgcatgtcgacacggcggtgcggcgttgcagcgcgctacgcgtgcctggccaggtatttcgcgatcagggtcatctgcgcggcccagccctgatcgttcatctcgcgcgccttcgcgcggcgcgtttcgatcaactgatcgaagcccgtttcggtgaccgtgagcagcgtgccgccggcctgcgccgcgagcgcgaacgtgacgagcgtcatcggttcggatgtgtaatcgacattcgggtcgatcgcgaacggatgccaacgaaaggagaacagttgcttcggctcgacgcgatcgacgacgatttcgaacacagtgcccgcatagggctcttgcgccttggcgacgtcgtcgtcgacgcgggtcggcgtgatgcggccgaacagcggctgcccggccgcgaacggcccgtcgaacgagacgccgaaccactggccgaattcgccggaattgctgacggctttccacacgcggtcgggcgatgcgttgagcagggcctgtttttcgatgcgatcggtttgctgggtcatgacgttctccacataggatcaacctttgccggacggcacgcgcgaccgcgggccgcgtctagtcgagcatgaccgcgtcgggcacgtcgagcacaaggtccgacgtcgcgacggccacgcacggcagcgtatagccgtcggccttttcctcgcggctcagccccggccattcgatcgtgtagcgtacgctgccgctgacgatccggcaaaggcagcttcggcatgtgccgttgcggcacgaacgcggcagcgacacgcgcgcgaacgcggcggcttcgagcagcgtgagcgaatcgggcgcatcgaaggtcgcgccgagcggctcgatgcgcacgagggaaggtgttccggatgggtcatggcgaaggcgggcggcgattcggcggcaacgcgccaagcatacccgaacgggctgacggccgacgcctgccggccgccggcgtcaatgccggcgcagatgccggtacacggtattgcgggcgaggccgagctcgcgcgcggccgccgacacgttgccgccatgccgtgccagcacggcatcgatcactgcggcctgatggtgttgcagcgtcgtgccttcatgcgggccggccgatgcggccggtgccgcggatgacggcgccgccggcgcgtcgtcgcagtcgagccagaaatcgtcgggcaaatgggtgagcgtgatttcgtcttcgtcctcggccagcatgccggccgtgcgcagcacgttggtcatctggcgcaggttgccgggccagcggtggcgcgtgaacgcgtcgagcacgtcggccgcgatgcggcgcggcatcggttcgctgcgtgcaagccgcgcgagaatccgctcgacgagcgcgggcaggtcggtgcgtgcggcgagcgccggcaacgtgaccgcgagcccgttgatccggtagaacaggtcttcgcggaacgtgccttccgcgatcatcgcgcgcaggtcgcgatgggtcgcgcagaccacgcgcacgtcgaccggcaccgcgcgcgcgccgccgagcggcatcaccgcgcgttcctgcagcacgcgcatcagccggacctgctgcgcgagcggcatgtcgccgatttcgtcgagaaacagcgtgccgccatcggcctgcacgatcttgccggggctgccgcgcttgcgcgcgccggtgaacgcgccgtcctcatagccgaacagctcggcctcgatcagcgaatcgggcaacgccgcgcagttgaccgcaacgaacgggccgtccgcgcgaggcgatgcctggtgcagtgcgcgggcgagccattccttgccggtgccggtctgtccgaggatcaacagcggcaggtcgcgcccgcggatcttcgcgacgcgttcgagcacggcggccatgcgtgcgtcgcccgtgtcgagcgtcgcgaacgtgatcgcatcggggtccgctgtgcgcacgcgtgcggcgggtgcgggcggcgtgacggcaacggcggtcttgtgcgcttccgcgaattcgcagcgcgccagcacgcgtacgccggtcgacagcgtgaggcggaacatcgcaccgggtgcgcgtgccgcctgctgcgcgagctggctgaagcgcatgccgaacagcgcgtcgctggcctgatgttgcagtgcgtcgaacgacgcgccgagctggaattgtgcgctgcggttcgcggcgatcagcccgccgtcggggccgaaggcgacgagcccggcgaacagcgaatcgacgcattcctcgtgcgcatgaaagcgcagccgcagggcttccgcgcactggttcgcgaacaggtggttctcgatcagttgcgcggacatccgcacgagcgcgagcgtgtgcgggctcgagccgcgcggatcgccgctgacgtcgagcgtgccgagcgtgcggccgaacgggtcgaagatcggcgcgcacgagcaggtgaggatgtggttggcgcgcaggaagtgttcgtcgccgtgcacggcgacggcctggcccgatgcgagcgcggtgccgatcgcgttggtgccgcgtgcgccttccgcccacgaaacgcccgtgcacagcgacgcggttggctttttcgatgaagtccgcgtcgccgatgctgtgcaggatgacgccgtccgcgtcggtcagcagcacgaggctttgcgtgtcggcgatttgcgcgtggaggttctccatgaccgggcgggcgtgcgagaacagcgcgtgattcgtgtcgagcagttcgcgcagcgcaatgcgcgacagcggcgagaaatcgggacgttcgtgcgcgcgcaggccgaccgcggtcgaacgcgcatgcgcctgcgcgagcaggtcggtgcgacccgcggcggcgggcagcacgaaaggttgcggcatgacttgtctcctgtcgacccgagttagcgctttagcgtttactctggtcccatgctttgcggtcggccagagttggcgctttagcgcttgctcgggtcccatgtttcgcggtcgacccgagctggcgcttaagcgcttgctctggacccatgcttcgcggtcgacccgagcttgcgttttagcgcccccaagccccacgctcctcgaatccggccgatccggcacacgtgctcgccggattcctctaccggttcccgcctgcgcgtgcggcgcaccatcgacgcgcgaacgccggccatccgggcacacatcatcatacaagcgccgcgtgcgatgcgcgaccgcgtacaaaatccacttgcttttaaatgcccgcctgcaatgatggaaacggagcacgcacgcgccgtgttccgcattgcaacatgcatgcgacgcgacatgcatccgttcgggagacgcatcatggttcggacggaactgagagtcgtgctggcggccatcgccacattcatcatgctgggcggcattgccgtggcgatccacgggctgctgttcgatctgaccgatgcggtgcgatatggggcggccgcgattgcggtcggcgccacgacggccgcaattgcgctcaacgtctggcccaacgaccctcactgacgccggtttccgaaacggtgccggatgccgcgctgatcagatgaaatgcgcgtcggaacgacgcacgccgtaaattttgtctcccgcgcgaaaccgtctaaagtggaaagcaaccggcatgcattacccgcgccattacccgcgggccgtgccccgccggcgagcccgcgtacatttcgtccggccggtggcggacgacggacgcggtcattcgttttctaccggtcgaggcgggtcccatgcaaatccatttcacgaacgagaagcccgagtattcggggcgcgacctgatgcttgcgttcacggcgttggtgaatggcgagcgcgttcaatgtcagatcaccgccgaggcgctggaagaccacttcggtgcggcttcgccgcgcttcgaggacatggtcggtgcattcgaccagcaccgcgaccgtatcgaggcggctgcacggcgcctgctgtcggagacgcgcgcgcaatgcgtgacgctgcgcagcggttacgtccgcttctacgaggccaactggcgctgacgacacgacgcccgtcctgctgcgcgcgtcgctgaacgccgcgcacgcgaagacgttgcctttcatgcgatgccgttcggcgggcccgggcggcattttcgtatgcgggccgcaccggattgctgccgcgcccggccggctgctagtgtgccggcacgacccggcgtatcgtttcgtcaggatcgcagagaaaatcattcgaatcaggcgctgaaactcgatccggcgaaccggctggcgctcgaggcaacgggcatcgcggcgattcgcagcaaccggcccgatgcggcggtcgggatcttcgagggcatgaaccgcgcgtatcccgacgacgcacacgtgatcgccaacctggcggtcgcctatcgccgcaccgggcgggtcgatgacgcgatgcagttgtaccgccgcgtcaagacgctggatccgccgctggcgcagcggctgtacgacgaggaactcaagggcgtcgcgacgccgtgatgcgcgcgggcggacccgcgcgacccgcccaacgaaaacgccacccgaaggtggcgttcgttcgtcgtgcatcgcgccgaagcgcgaccgtcactcgctgccgagatagaagaagcggaacaggaacacggccgcgatgatccacacgatcggcttgaccgagcgggcctggcccgtcagcagcttgaggccgccgtaagcgatgaaaccgaacgcgacgccgttcgcgatcgagtacgtgaacggcatcagcagcgcggtgagcgcggccggcacggcttccgttgcatcgtcccacggcacctcgaccatctcgcgcagcatcaggcacgacacgtacagcagtgccggtgccgtcgcatatgccggcacgacgccggcgagcggtgcgatgaacaggcacgcgaggaacagcaccgcgacggtgatggccgtcacgcccgtgcggccgccggcctgcacgcccgatgcgctttcgatatacgcggtggtcgacgacgtgccgagcaccgagcccgcgacgatcgccgtgctgtcggcgagcagcgccttgttcaggcggttcatcttgccttcgacgagcaggcccgcgcggttcgcgacgcccatcagcgtgccggtcgcatcgaacagctcgacgaggaagaacacgaggatcacgttgatgatgccggtcgacagcgcggcgccgatgtcgagcttgaacagcgtcgcatcgatcgacggcggcgcggagaacacgccgtggaactggttgccgccgaagaagaacgacaggatcgtcacgccgatgatgccgatcaggatcgcgccgcgcacgcgcaggtggtcgagcgtgacgatcgtgaagaagccgatgatcgcgaggatcgtcgtgggcttgtgcaggtcgccgagcgtgacgagcgtggccgggttgccgacgatcacgcccgacgtcttcagcgagatgatgccgaggaacaggccgatacccgcggtgatcgagatccgcagcgatttcggaatgccgttgacgatcgcttcgcgcacgcggaacagcgtgacgagcaggaacaggcagccggagatgaacaccgcgcccagcgcggcctgccacgtgaagcccatccccttgacgaccgtgtacgcgaaatacgcgttcaggcccatgccgggcgcgcatgcgatcgggtagttcgcgtacagccccatgatgatcgatgccagcgccgcgacgaggcaggtcgcgacgaacacggattccttcggcatgccggcgtcgccgaggatcgcggggttgacgaagatgatgtaggccatcgtcaggaacgtggtgacgcccgcgagtatttcggtgcggaagtcggtgccggcttcagcgaagccgaaataccgcttgatggattccatgaaggcgtttctccggtcgggttgtcgtgttgcttgttgtgccgaattgttgtacaggcagcggacggcgggcttaatgtaaccagccactattgcccggctatcggcggattgtaatagcgcggatagctcggacgatatagttgggggcacgatcgcaagatcggtcggctgcccgcgcgcgaacggtctggcagcccggccgcgcggcgaaggcgcgcattttaccggttcgggtggaacgaaccggaagaaatggcggaaacgggagcaaggcaaggaggcgaggcaagcgaacggagccggccgatgcgtgcgcaacaacgtgcgaagcgagtgcaaaccggacgtgcaagcggacgcacaaagcggcgcacggtgtggcgcgtgtggcgggtgcgggatgacatccggctgaaacggagcgcccgcatgctgcacgaacgtggggcaggcagcacgtgcacggcccgtgcgcaggcccggcagcggcgtgcagccgccattcttcagtccaggcggttgccgatatcgggctatcgtgcgccgaagccgtcccgcccgcaactgtcatgtcgtgatgcgggggcgactgtggtttctgtgtaaaagattgcaagaccccatcgcataaaccggcaagtctttctaggatagatacaccgcgcatgcacacgccggccggtaattgccgacgcggggagtcgcagtccgtgcaggccgggcggtgaagtgcggtcaaggccgttgcgcgttcgggcaggcacggccgattgcgattgcccgatgcgggttcgtccgtaatcacggaggtcagcatgttgaactggatcagccgttgggcgatgcgacacgcccccacgccggaaaaaccgctgcgtcgatgctcgtgacggcgcgcatggaactgttcgctgccgaacagcgcgtcatcgacgcgaaattacaagcggattactggcgcacacgtgtgtcattcctcgaggaggtgcagaagcagggcatcgatccgtgggtgacctcgcaggcagcgcaacgccccgacctcgattccactcccgcagcacgggcccgcgtctcgccgccagcacctgatgcatcagctgcatcgcggcgcgcgatcgctcgcggcacgcaccggcgtgccgcgtcattcgatgcgcacccgcggcgcctcatgccgcgggtgcgtctgttttcggtcgcggccgttccgcgtctcgcgtgcctgacggcacgtcgctcatccactcctttccgctatcccgaagagcaaacgttgcacttgcgcgagcgtgcgcctgaagcgctcgccgcgacgcacgtacgcggtcgtgagcgtcgcttcggccggccggtcggcaacggtgccgagccagatgcgttcgccgcgtgcgatgcgcagcacgtcgccgggctgcacccagcaatcgtcgacgctcggcgggcgcgtgacccacagcgccgcgccatgcgtgcggagctccgcgtcccgcggcgcacgccaggtcatcgtcgtgcgcggcacgaccgcgaaacggatcacgacagtcggtaacgcgatcgtgccggcgtggcgccgatcgggacggtcaaacagcgggcttgcctggtccatcgtcttctccagtgattgagccggatggatgacgcgcaccagaacaaaaaggcctcatccgtttccggcgaggccttgtgtgacatgcggtactgcccgattgctaacgcacaagcgcctcccgtgaaccattctttcgaatgttcatcgatcgatgaatcgaggcggagacgagcgtgtacgtaggcatgcgaacgagtttgtcttcgtggaacggcgttgtcaacgacaattttcgagatagtgcaggggatgcgtcggcggctgcgcgcgagtggcagcgcacccggatcgcatgcgtcgcgacgcgttcgtcatgagcgacttcgacatcgttcgcgcaacaggctgcgcattcgtacaagcgcacgcgcgagccatgcactgtgtcccgtcgcgtacgcggtcgtgatcgatgcttcggccggacgggtgtcgtcggtgctcatccagatgcgatcgccgcgccgcacgcgcagcacgtcgccggttcgtatccagtaatcgtcgacgctgcccagccgcgtgacccacagcgtcgcgtcgtgcacgcgaatctcggcatcgttttgcgcgcgccacgccagcgtcttgcgcggcgcgaccgtgaactggatcacgacccgcggcaacgcgatcgcatcggtgcggcaccgatcggggcagacaaccagccggcttgcttggtccatcgtcatctccatccgttgagccgggcgggatgacgcgcaccaaaacaaaaaggccccatccgtttccggcgaggccttgtgacatgcgcaactgaatctcgatgctaacgcacaagcgcctccagtgatcgccacggatgggcgttcactcggttttcatgcgcgatggcggcgggcttgagcataagcatgcgaacgagtgtgtcgtggcagcgcatcaatgtcaacggaaatttcgagatgcgtgacggttacgcgtcgcgttgcgcgaggccgttcacgagcagctcggacagcaggcccgtcatcccttccgggtgcgtggccgcgcgcgccttcagttgttcgacgagttcggcgttgagcttgcatgcgaacggcacgaggccctgttcctggtcgagcttgcgctgcgcgcggcggtcgagcttgacagcttcttcggcacccttgccgaaacgcgcggaactcgactgcttcatcgcgtgcgtcagcttgagcgccttgttctttcgagatcggttttcttcatggccatcgcggcacctccgggaaattgaagccgcgattgtacgcatttcggcgggcgccgcccgtggagccggcaagaaacccggtcaggcgcccttcgtcgtgccccagttgccgccgtgcgcggccgcctgtgcggccggcgagcgggcgaggtaggcgagcgcctgttcggtcgagccttcgtgatgcggcgtatagccgggcttgaaatagcgcagcgccgcgccgatcaccttccagaacgacggcaggtgcccgcgccgcgagccttgccaccacgcgagcacgaaacccgggtagcggccggcgtccgggtcgcgccggtacatgaatttcgcgcccgtcgtgatgtagtagagcagcagcaggatcacgaacgccatgtgcacgcagcgctccggataggtgccgcccatgtgccggtagatgtcgaatgcgaccgtgcggtgctcgacctcttccgcgccgtgccagcgcagcaggtcgaccatcgtcgggtcggctttccctcgtcgagcccgtgcgcgttgagcacccagttgccgagatagccgaagaaatgctcgagcgacgcgatcaccgcgagctgctgccgtagccagaaacgcgtgtggccgatcttcagcccgagcggctgttcgccgagcacgcgcgtgaacagccggttgagcttttgcgtgaacggcttcgtgtcgatcccgtgccggtcgtagtagtgcttcagcacgccgccgtgcgaacgcgagtgcacggcctcctgccgcaggaagccttcggcctcgtcgcgcaggcgcgcgtcggtgatcagcggcaaggccttgttgtacacgcggcagaaccacagctcgccttccgggaacagcaggttcagcgtgttgatgatgtgcgtgctgcccgggtcgttcggcacccaggtgaccggcgtgtcgctgaagtcgaacttcacgtgccgggccttgatcttgtgatagtcggcggtatcggtcatctttgtctccctgtgcggcgtcgtgcgccgtcaatgcgatgccatgctgacgcgggcgatcatccggccgagccacggcatgaagcggccgacgaaacgcatggcatgcgcctcgccgccgacggcgacgacgggacggttgcgcagcacgccgtcgaccatcgcctgcgcgacggtttcgggtttcaggccgcgcatctggtacagcttcgtcgcgcgcttgcgcagccgcgcttcgtcctgtgcattggcgcccgcgtattgcgtcgacgccatgattccggtctccgcgaagccggggcacacggccgtcacgccgatgcccttttccgcgagctccgcgcgcatgcattcgctgagcatcagcacggcggccttcgtcgtcgcatacgcgggcaggtcgcgcgacggcccgaacgcggcggccgacgcggtgttgacgatgtgcccgccggtgccgcgcgcggccatctgctgcgcgaacagccgcgagccgtggatcacgccccacaggttcacgtgcaggatgcgctcccagtgccgcgtgctcgtgtcgaggatgccgccggccatgccgatgccggcgttgttgatcaccacgtcggcgccgccgagttcgtcgccgacccacgtcgccagcgcttccatttcgtcggcggacccgacgtcgacgcgtttcgcgtgggcctgcgcgccggtcagcccgatcagcagcgcggtgcgttcggcgctcgcgagatcgatgtcgcacgcgacgatcgtcgcgccttcgcgcgcgaacgcgagcgccgcgcagcggcctatgccgctgcccgcgccggtgacgaccgcgaccttgccgctgaagcggccgctcgttgcacggcggcgcgcgttcgcgagcgcgggcggctcgttgcccgattcgaccgcgtcgatcagttgcccggccagatccgcgaagcgcgccggatcggcgagcggcagccagtggccggccgcgacctcacggcggtagtactgcggcacccagcgcgacaggttctcggacagcgcggggctcacgtacttgtcgccgagcggcacgatcgtctgcaccggtgcatgcgcatggcgttcgcgcggcgcgaacaggcaacggatgaagttcgcgcgatagaggcgcacgccgcgcgcgccgtcgtcggcttgcgtcggacgcggcgcgacgggcgttttctcgagcctgcgcagcaggcgcggccacgcgcggccgagccacagccgccagccgagctccgggatgaacggcaggtggaacaggtacacgtaccacgagcgcacgagctggccgccgagcttggcgagcgacgcgggcgtcgggtgcagcacgcgttcgcgcagccagaagccgacatggtcgaggcacggccccgagcacgacgtgtatgacgcgatgcggccggaaaggcgcggatcggtgacgaattcccagccctggatcgagccccagtcgtgcgcgaccagatgtacggcgcgaccggggcagagcgcgtcgatcaccgcgacgaaatcgtcggtcagcttcgcgaggtggtagtcggccgtgcgcttcggcgcgccggacagtcccgcgccgcgcacgtcgtacgcgatcacgtagtgcttgcgcgcaagcagcggcgcgacgtgctgccagacgctgctgtcgtcgggataaccgtgcacgagcacgaccggcgagcgggccgggtcgccccaggtcctgaccgcgagcgtcaggtcgccggaggcgaccgccgtttcgccatgaaccgattcgaacagggccagcggcgcttcgtcggaaagaggctgcatcgtgagtccgtcgttcagggagtggggagaaaggcgggttcgcgtcaggcggcggccggcacggtcgcgacggcctgcgcacgctcggccaggcggcgctgccagcggcgcacgtgcggcaggtcgtcgtcgagccagtacgcgtcgtcttcggtgatcacgagcagctcttcgaatttcgcgccgacgccggcgaagccgagatgcggctcgacggcccacaggcccggcacgggtgcatgctcggagcggcggtcgatcgaccacagcggcgaccagccttgctgtttcgccgcgcgcccctggtcgagcagcaggttgcgcgtcgcgttcaacccgaagcgcgcgacgaagcgcggcttcgacagcttgtggatcttcgcgacgcgatgcgcgagcaccttgaacggataggccttgtggcgcggctcgacgccctggcggcggcacagcgcgtcgacttcctgcgcgacctcggccatcggccggcgcgccttcacaagccgcacgatcaggtcgcgatggtccatcaggtcgtcctgcaactgctcgaggatcgggttctggccgaggcagtgcgcgtagccgacgtcggccacgatgccgtcgagcaccggcgcgacgtcgaggatcaccggcatgtcggtttcgagctgccggttgctcgggaagaacgcgagattgaagccgcccatgtgcttgaggcccgagaagccctggaaggcggtgcggtcgccgaaccacgcgaacggcttgtgcagccagtcgtgcacgccgttgtcctgcagccattcggtcaggaggcgggcggcttccttttcggtgatgccggggtagagcatcgcgccgacggtctcgacacagcggtaggcaagctgctggaccgtgcggaattgcggcagctcgtcgaggtggacttccggcagcgagtggtcggccatgatgcgtctccaaggggcgctgatccgaatccgtccgccggcgtcgccgtcacgggttattcagtcagcatttaatgtgtcattgaacaatgtaacgatcatagacggttccgcgtgccgggacgtgaggatttgtcctaatggcagggggaaatggagggagcctctaggtttccggacgatgtcgcgagcgggtgcgtcgccggaccggacggccgtgttcgatcgtttcgtgatgcccggcatgtcgcgccggatcaactcgccgtcgtgtcgcggcgtgacgctgtcaaattgccgaaataatttcgacacatcattcgcccccgattcgaagccgtcccggcttcgcggtggcgatgacccgccaatgcgccgcacggggcagtgaacggaaccgattcgacatttccacggagagaccatgcaacgccgccagttcatgaacacccttgccgcggcgaccgctgcgacgtcgctgatgctcaaggccggcaccgccgacgcaaagagcgccaccgcgccggacgcgctggacccgggccgctggtcgccgttcaacgccgcgcgcctgcaggcggtgctcgaccaacatggcgtcgcgagcgcgcgctacgacgaaaagcgccgcccatacgcggtgttcgactgggacaacacgtgcatcatgaacgactgcgaagaggcgttgctgatgtaccagatcaaccatctgcaatacaagctgacaccggacgaattcgtcggcgtgatgtggaaggacgtcccgaagggcgcgttcatgaaggactacacgaccgtcgacggcaagccggtgacgatggaggatctcgccgccgacgtcgaatccgactaccgctggctctacgcgaactacaagggtttcggcggcagcaagagcctcgacgagattcacgagaccgaccagttcaaggatttccgcgcgaagctgtacttcatgtacgacgcgatctgcgacacgcacccgctcgaagtcggctacaagtggatcatctatttctacaagaacatgacgaccgccgagctgcaggcgatggcggaagcgtcggacaactacggatcggcgacgcgctgcgcaaggttcgctacgaaagcccgaagacgctgccgggcaaggccggcgtcgtggccgacacgcatttccacggcattcgcatccatgaggaaatccgcgcggtgatgcacacgctgcgcgcgaacggcatcgacgtgtacgtgagcaccgcgtcgctcgacgatgtggtgcgcgtgttcgccggcaatccgaactacggctacggcgtgccgccggagaacgtgatcggcctgcgcctcgacatgcaggacggcaagtacacgagcacctatccggctggctggcatttcaactggggcccggcaagacggtgggcatccgtaacgtgctcgtatcgaagaagggctacggcccgctgctggtgttcggcgacagcgacggcgacgcgtggatgctgcgcgacttcaaggacaccgcggccggcgtgatcgtcaaccggatgaagaagggcgagatcggcgcggacagcaagctcgcggccgggcagatcggccagccggatgcgcgcttcctgctgcagggccgcgacgagcacacgggcctgatgattcccgacgagaagtcgatcaagtacggcaagagcgagcgcaagctgctcgcctgacgggtgccgggccgtggcggcccggtgtccggcgggatcgacggcggcgcgtcgcgcgggccggaactcgcgcgtctcagcgctcgcgcggcgtacccagccgatccagcaacgccccagcaagtcgaccggcagcggaaacacgaaaatgaaggagaagcgccggaccgggcgccggacgatcgatcgggtgcgggagtggcaccgaatccggagagggaagcggatcgagctcgcaacggaggaggcggacaataaaaggacgcttgcgcgtccttttgccgtctgaagtgttgcgcatcatcgagaggcgtccccagcgttttcatcggcaatgctagcgaagtatcgaacgaatgtcaaaatgcagcgcgtcgaaagcggagcgtgagcggccacctcccataccattcggcagatgggggcggtcggtatcgatgcctgttgcccctcgtccggcgaatccggtgaggatccgaatatctgcctcatccctcccgctttcctcccaaccgatccagcaacgcccccagcagatcgatcggcagcggaaacacgatcgtcgaattcttgtccgccgcgatcgtcgtcagcgtctgcaggtagcgcaactgcatcgcctgcggctgcagtgcgagccgctgcgcggcctgcagcagcttctccgatgcctgcagttcaccctccgcatgaatcaccttcgcgcgccgttcgcgctcggcctcggcttgccgggcgatcgcgcggatcatcgtctcgttcaggtcgacgtgcttgatctcgacggtcgataccttgatccccatgcatcggtctgcgcatcgagcgtcttctggatgtcggcgttcagctgttcgcgctcggccagcagcgcatcgagctcgtgcttgccgagcaccgaacgcagcgtcgtctgcgagagctggctcgtcgcgtcgaagaagcgcgcgacctggatcacggccttctccggatcgacgacgcggaaatacacgaccgcattgaccttcaccgacacgttgtcgcgcgtgatcacgtcctgcggcggcacgtcgaacacgacggtgcgcagatcgatccgcacgacttgctgaacgatcgggatgatcagcacgagccccggccccttcactttccagaaccggccgagcatgaacacgacgccgcgctcgtactcgcggaagatgcggatcgacgacgcaacgagcaccacggcgaagacgatcaggacgctgctgaagccgaatgtgtagccgatcatgttggttcaccttgatgttgttgttcctgcgccggcacgtcgtacagcggcgcgacggtgagcatcagcccctggcggccggtgacgcgtacgcggcagccggctgcgagcggcacgctgctcgcgacgcgccagcgctcgccatgcacgcgcgcccagcccgcggccgatggggcggtgccggccgcgccgtgcggctggtcggcgcgcaggccgtcgtcgagcacctcgccgatgctgccgaccatcgcctcggcacctgtcacgaccgggcgccgccgcgcgcgcagcgcgacgctcgacacgcccgcgacgagcagcccgccgccgagcgccaggctcgcgatcacgggccacggaatcccgtagccgggcacgtcggtgtcgatcagcatcagcgcgccgatcgtgaacgacacgatcccgccgaaaccgagcacgccgaaggtcggcaggaacgcctcggcgaccaggcagccgaggccgagcagcacgaggccgaggcccgcatagctgatcggcagcaactgcatcgcgaacagcccgaccagcaggcagatcgtgccggcgacgcccggcagcacgaagccggggttcgcgaactcgaagaagaggccgtagatgccgatcgtcagcaggatcagcgcgacgttcggatcggcgatgatcgcgaggaagcggctgcgccagtcgggttcgacgatgacgagcggcgcatgcgtggtcgcgagcttcaccgtgccggcggtggtcgttgcggtatggccgtcgagctggcgcgcgaggtcggccggatcttgcgcgatcaggtcgacgacgtgctgcgcgcgcgcctcgctggccgacaggctgacggcttcgcgcaccgcgcgctcgccccattcggcattgcgcccgcgcagctgcgcgaggccgcggatgtaggcggacgcgtcctgcatcgccttgcggatctcggtcgattgcgtgtcggtcggcaatgcggcctgcgtggcggcctcggacgcaccggatgcccctgacgcgcccggggttccggccggcgggcgcggtgcagcgggttcgcacccggcggcgcggcgccgccgatgccgaactgcaccggcgacgccgcgccgagattggtgccgggcgccatcgccgcgaagtggctggcatagacgatgtaggtgccggcgctggcggcccgcgcgccgcccggcgcgacgaacgcggcgaccggcacgggcgagccgaggatggccttgatgatctgccgcatcgacgtgtcgaggccgccgggcgtgtcgagctgcaggatcgcgagcggcgcgtgctggcgtgccgcacggtcgagcgagcgcacgatgaaatcggcgctggcgggcccgatcgcgccgttgatcgggatcacgatgaccgggcgggcggcggcgggtgcggcgggtgtgtcggcggacggcggcgcggcgaccgcggcgaccgcggcacacacgacgagcagcgccgcgaacagcgcggcgcgcgcgacccgcgcggacagcgggtgacgagggtggccgccgggcgtggcaggcaccggcgacggcccgtgacggtgaacgtgcatcggggcgtccgggcggcgcgtggccgtgcgccatccggcttgcggaaagggcgtgggcccgatgcttaaagattaggcggtttcggcggaaagcgcgaagcgagcgccgtgccggccggcctcagctcgcgccgccgccgcgcgcgagcacttcgtcgcgatagtcggccgggctgcgtccgctccatttgcggaatgcgcggtagaacgcgctcggttccgcgaaaccggttgcagccgcgacgtcggcgatcgtgcgcgcgggtcggccagcgcctcgaacgcgaggtcgcgccgcagcgtgtccttgatcgactggtacgcgtggccttcctggtgcagcttgcggcgcagcgtggcctcggccacgtgcagccgcgcggccatcccgcccgcacccggccacgcggcgggcggcatcccgcgcagcaccgcgcgcacgcgctgcgcgagcgcgttcgggttgcggtacttgacgatgaagctcgccggcgcgttgcgcaggaacgtcttcagcgacttcgcgttctgcacgaccggcagcgtcgcgaattcgggatcgaaatcgacatacgaatcgggttcgttgaaacgcatgtcgtcgcagaacatcgacggatattcatggtcggcgggcggcgtgtcgcagcggaagctcgcatgcagcagcgggatgcgccgcccgatcagccagcaggtcagcccgtagacgatgatgaaataggtcgcgtacgtgaacatcgccggcgtcgcaccgttgttgcggtgcacgaagcgcagccgcacgcgctgcgggttcgcgtcgagctcggcgtgcaggtcgtcgagcacgcagtgcatgaaattcaccgcgcgcgccatcgcgtgcaggccgtcgcgcgcggtcagcgccgcctggctcatcgcgatgaaactgccgctgcgcatcgggtggcgatcctgcccgaaaaactcgtcgtcgagcgtgcgcgcgatcgcgttccacagtgcgccatattgttgcgcggacacgcgtgcgcgcggctgcccgagcagcgccggggcgatgccggcctgcgcgagcagcggttcggccgcgacgccgcgccgggtcgcgagcgcgacgctgtaagcgacgaggctgatcgcgacggttcccttgtcttcctgcttcatccgtgccgccggtgtggcaaaaacgctcagtgtaaatgagcggcgcgagcatcgaacagtcgcgcgtgcttgcctacacttgttgcatcgaaacgcaaggacggtcgcgcccggcggccgcgggagacagcagcaccatggacgagctttacaccgaagaccagcggatgatccgcgacgccgcacgcgcctttgccaccgagatgctggcgccgaacgcggcgcagtgggaccacgatgcgcacctgcccgacgccatcgtcgcgcagctcggcgaactcggcctgctcgggatgatcgtgccgcaggagctgggcggctcgtatacggactacgtggcctacgcgctggcgatggaggaagtcgccgccggcgacgccgcgtgcgcgacgatgatgagcgtgcacaactcggtcggctgcgggccgatcctcggtttcggcacgcccgcgcagaaggatcgctggctggccgacatggcggcgggccgcgtgatcggcgcattctgcctgaccgagccgcaggccggctccgaggcgaataacctgcgcacgcgtgcggaactgcgcgacggcaaatgggtgctgaacggcgcgaagcagttcgtgaccaacggccagcgcgccggggtggcgatcgtttttgccatgacggacccggaagccggcaagcgcggcatttccgcgttcctggtgccgaccgacacgccgggcttcatcgtcggcaagcccgagaagaagatgggcatccgtgcatcggatacgtgcccgatcacgttcgagaactgtgcgattccggaagaaaacctgctcggcaatcgcggcgaagggttgaagatcgctttgtcgaatctcgagggcggccgcatcggcatcgccgcgcaggcactcggcatcgcgcgcgccgcgttcgacaaggcgcgtcgttatgcgggcgagcgcgtgcagttcggcaagccgatcgccgagcatcaggcgatccagcagaagctcgccgacatggccgtgcagatcaacgccgcgcgcctgctcgtgcatcacgcggcgaagctgcgcacggccggcttgccgtgcctgtcggaagcgtcgcaggcgaagctgttcgcgtcggagatggccgagcgcgtgtgttcggacgcgatccagatccacggcggctacggctacctggtcgattacgaagtcgagcgccactatcgtgacgcgcgcatcacgcagatttacgaaggcaccagcgaagtgcagcggatggtgatcgcgcggcagctttgagccgcgacattccgcgtcgaaaggaagcatcgcgcagggcacgagggcagtgcggtgaacgcggcacgcaacgacgtgaccgtgcaccgcgacagaggagaccgggcatgcgctgcagccatgttgccggtttaccgcgaggcatgggacgagggtaagtgttgaagcgtcaactcgtcgaccgcgcaggcatgggacgagaagcgctaaagcgccaactcgtcgaccgcacgaggcatgggacgagtaagcgctaaagcgctaactctcgtcgacaggagacaaaacgatgacggtacaggcattcctgaacgcacgcgattttctgctgcgccatcgcaccgactacgaaaccgcgtaccgcgatttcgaatggccggtgctcgacgcgttcaactgggcgctcgactacttcgacccgatggcgcgcggcaacgaccagcccgcactgtggatcgtcgacgcggccaccggcacgggcgacccgtattcgttcgcgcagatgtccgagcgttcgtcgcggatcgcgaactggctgcgctcgatcggcgtcgtgcgcggcgaccgcatcctgctgatgctgccgaaccgtgtcgagctgtgggacgcgatgctcgccgcgatgaagctgggcgcgatcgtcctgcccgccaccacgcaactgtcgcccgacgacgtgcgcgaccgcgtgcagatcggcggcgcgaaatacgcgatcgtcgacgagaacgaaaccgcgaaattcgaccagcccgacctcggcctcgcgcagaagatcgtcgccggcgcaccgcgcgcgggctggctcgcgatgaacgacggttatgcggcgagcgccgaattcgagccggacgccgtcacgcacgcgaacgatccgatgctgctgtacttcacgtcgggcacgacgtcgaagccgaaactcgtcgagcatacgcaccgcacctatccggtcgggcacctgtcgacgatgtattgggtcggcctgcagccgggcgacatccactggaacatcagctcgccgggctgggcgaagcacgcgtggagctgcttcttcgcgccgtggaacgcgcaggcctgcgtgttcgcattcaactacgcgcgcttcgagccgaaggtggtgctcgatgcgctcgtcaaataccaggtgacgacgctgtgcgcgccgccgaccgtgtggcgcatgctcgtgcagcagccgcttgcgtcgttcgacgtgaagctgcgcgagatcgtcggcgcgggcgagccgctgaatcccgagatcatcgagcgcgtgaagaaggcgtggggcatcgcgattcgcgacggctacggccagaccgagacgacctgcctgatcggcaactcgccgggccagccggtggtcgcgggctcgatgggccggccgctgcccggctaccgcattacgctgctcgacccggacggcgcgcccgtgaccgaaggcgaggtcgcgctgccgatcggcgccgacgtcgcgcgcccggtgggcctgatgaaaggctatgcgaacaaccccgatgcaaccgcctacgcgatgcgcgacggccactaccgcacgtcggacatcgcgatgcgcggcgacgacggttattacgtctacatcggccgcgcggacgacgtgttcaagtcgtccgactaccggctgagcccgttcgaactggaaagcgtgctgatcgagcatccggcgatcgcggaagcggccgtcgtgccgagccccgaccccgtgcggctgtcggtgccgaagaccttcatcacgctgcggcagggctacgaggaaagccccgcgctcgcgctggagatcttccgtttctcgcgcgagaagctcgcgccttacaagcgcatccgccgcctgcagttcgccgatctgccgaagacgatctcgggaagatccgccgcgtcgagctgcgccgccgcgagatcgagcgcggcgacgacgcgagcgcgcgcatgcccggcgaatactgggaagaagatttcgctgccgaactgaaatgacgtgaccgcgggccgcgcgccgcctgtcgcggccgccgcccgcagccgaattgaaccggccgcgcggcgatatcgcgcttcgcggccctctgcaaggagaagggatcgatgaacgcgaatccgacgccccaaacggggcaagacgtgccgacggtcaagctgctgatcgacggcgcttttgtcgagtccgccacgaaagagtggcgcgacatcgtcaatccggcgacgcagcaggtgctcgcgcgcgtgccgttcgcgaccgtcgcggaagtcgacgcggccgtgcaggccgcgcacgccgcgtatgcgacgtggaagaacacgccgatcgccgcgcgcatgcgcatcatgctgaagttccaggatctggtgcgcacgaaccagcagcgcatcgcgaagacgctgacggccgagcagggcaagacgatccccgatgccgaaggcgacatcttccgcggcctcgaagtggtcgagcacgcgtgctcgatcggttcgctgcagctcggcgaattcgcggagaacgtcgcgggcggcgtcgatacctacacgctgcgccagccgctcggcgtgtgcgcgggcatcacgccgttcaacttcccgcgatgattccgctgtggatgttcccgatggcgatcgtctgcggcaacacgttcgtgctgaagccgtccgagcaggatccgatgtcgacgatggagctcgtcgagctcgccatcgaggccggcgtaccgaaaggggtgctgaacgtcgtgcacggcggcaaggaagtcgtcgacgcgatctgcacgcatccgctcgtgaaggcgatctcgttcgtcggctcgaccaccgtcggcacgcacgtgtacaacctcggcagcgcgcacggcaagcgcgtgcagtcgatgatgggcgcgaagaaccatgcggtcgtgctgcccgatgcgaaccgcgagcagacgatcaatgcgctcgtcggcgcgggcttcggcgcggcggggcagcgctgcatggcgacgtcggtcgcggtgctggtcggcgaagcgcgcgactggctgcccgatctcgtcgcgaaggcgaagctgttgaaggtgaatgcgggcgcggaagccggcaccgacgtcggcccggtcgtgtcgaaggccgcgaaggcgcgcatcctctcgctgatcgaagcgggcgtgggcgaaggcgcgaagctcgaactcgacggccgcgacgtgaaggtggccggctacgaaagcggcaacttcatcggcccgacgatcttctcgggcgtaaagaccgacatgtcgatctacacgcacgaaatcttcggcccggtgctcgtcgtgctcgaagccgacacgctcgacgacgcgatcgcgctcgtcaacgcgaacccgttcggcaacggcgtgggcctgttcacgcaaagcggtgcggccgcacgcaagttccagagcgagatcgacatcggccaggtcggcatcaacatcccgatcccggtgcccgtgccgttcttcagcttcaccggctcgcgcggctcgaagctcggcgatctcggcccgtacggcaagcaggtcgtgcagttctacacgcagaccaagacggtcaccgcgcgctggttcgacgacgacacgacggccggcccggtgaatacgacgatccggctgcactgagccgtggaggacaccaaaatgaaaatcggttttatcggcctcggccacatgggcgcgccgatggcgctgaacctgctgaaagccggccatgaagtgcacgcgttcgacctgagcgccgacgccttgcgcgcactgcaggatgccggcgcacaggtggccgcgtcgccgcgcgatgccgcctcgggcgcgacgttcgtcatcacgatgctgccggccgcgccgcacgtgcgctcggtgctgtccggcgagaacggcgtgctcgccggcctcggcgcgggcgcgaccgtgatcgattcgagcacgatcgacccggcgagcgcacaggcgttcggcgcgctcgtgcgcgagcacggcggcgcgttcgtcgacgcgcccgtgtcgggcggcaccggcggcgcggcggccggcacgctgaccttcatggtcggcggcagcgacgcggatttcgagcgcgtgaagcccgtcctcgcgggcatgggcaagaacatcgttcactgcggtgcgacgggcatggggcaggtcgcgaaggtctgcaacaacctcgtgctcggcatctcgatggcggcggtgtcggaggcgatgtcgctcggcgtcgcgctcggcatcgacccgaaggtgctggccggcatcgtcaacacgtcgacgggccgctgctggagctcggacacctacaacccgtatccgggcgtgatcgagaccgcgccgtcgtcgcgcggctactcgggggcttcggcaccgacctgatgctgaaggatctcggcctcgcgaacgacgccgcgaagcaggcgcgccagcccgtctatctcggcgcgctcgcgcagcagctgtaccagacgatgagcagccgtggcgacggccagctcgatttctcggcggtgatccgcctgtaccaaccggccagcaagaaggacgcgtcatgatcgaactggactacgtcgacgacggcgcgatcgcgtgcgcgacgctcaagcgtccgcccgcgaacgcctttaccgccgacggcctgcggcaactgcaggacaccgtcgccgaactgaatgcgaacccgcgcgtgcgcgctggtgatcacgggcgacggcccgaagttcttcagcgcgggtgccgacctcaacaccttcgccgacggcgaccgcgcggtcgcgcgcgcgatggcgtcgcgcttcggcgcggcgttcgaggcgctgcacgacgcgcgtgtcgtgacgatcgcggcgatcaacggctacgcgatgggcggcggcctcgaatgcgcgctcgcatgcgacctgcggattgccgaaacgcatgcgcagatggcgctgcccgagccgtcggtcggcctgctgccgtgcgggctcggcacgcagacgctgccctggctcgtcggtgaaggctgggcgaagaagatcatcctgaccggcgcgcgtgtcgacgcggccaccgcgctgcgcatcggcctcgtcgaggacgtcgtggagtcgggcgcgtcgcgcgatgcggcgctggcgttggcgcgcaacgtcgcgcggcagagcccgcatgcggtcgcgtacagcaaggagctgatcggcctcgcgcgccgcggcgtgccgcgcggcgcggcgctcgcggtcgagcgcgaacgcttcgtcgacctgttcgataccagcgatccgcgcgaaggcgtggccgcgttcctcggcaagcgcgcgccgcagtggcacaccgacggggaggggcaacgatgagcacgccggtcacgaatcacgactcgttcgcggagcatgccccgaggtgctgttccgcgtggtgaatcgcgtggcgctgatcacgctgaaccggccggccgcgctcaacgcgctgtcgtacgcgatgatcggcgagctggccgcgctgctcgaacgttgccgccacgacgaccagatcgtcgcggtcgtgctgcgcggggcgggcgagaagggcttctgcgcgggcggcgacgtgcgcgcgctatacaggatggtcgcgcagcgcgaaacctggctgccgttcttcgtcgacgagtatcggctcgactacgcgatccatacgttcccgaagccggtggtcgcgctgatggacggcgtgacgatgggcggcgggatgggccttgcgcagggcgccgcgttgcgcgtcgcgaccgagcgcagcaagatcgcgatgccggaaacgcgcatcggcctcgtgcccgatgtcggcgcgacgcatttcctgtcgcgcatgccggcggaactcgagctgtacgtcgggctgaccggcgcgatgctgtccggtgccgacgcgctgaccgcgaagctcgcggatctgtgcgtgccgtccgcgtggctcgacacgttcgagacgcgcatcgaaagcgtcaagtgggaaggcgatgcgctgccgctgctgcgcaaggtgttcgagccgccgtgcaacgtggtgccgcatgcggcgctcgacggccagatgccgtggatcgtgcgtcacttcgacaagcgctcgaccgtcgagcggatcgtcgcgacgctgacgcaggatctcgcgcgcgaggaactgtcgcgcgagcaccgtcaatggctgcaggcgacgctcgatgcgctcacgggccattcgccgacgatgctgtacgtgacgcgcgaggcgctgctgcgcggccgccagatgacgctcgccgaatcgttccggatggagctcggcatcgtcgcgcgcgcgatcgaggaaggcgacttctgcgaaggcgtacgcgcgcatctcgtcgacaaggatcgcaagccgcgctgggcacccgcgtcgctcgtcgagctgcgcgccgaacgcgtgcggcatttcctcacgtcgccgtggaagctgttcgcgcatccgctcgccgatctcggcgtggcgtgagcgcgtagccggcgcgccgtgcgggcacaggctgccgcgcggcgcgcgtgtcatttcaccgctcgatcatcggcggaatcgcctgcgcgaacgcgtcgatcacgcagcgcgtcttgcgcggcaggtagcgcgtcttcggccagatcgcgtggatgtcgccttcgcagacgaagcagcggtcgagcacgaccgtcatctcgccgcgcttcacgtagtgatcgagcagccagctcggcagccaggcgatcccgaaccccgatgcgccggccgccgcgatcgcctgcacgtcgtcgaaactgagctggtgcggcatgtcgatgcgtaccgtcgagccgtccggcgcgcgcaagtcccacggttgaaccacgcccgaacgtgaatacgcgatcgtccggtgatgcttcaggtcgtcgagcgtcttcggcatcccgtggcgggcgagatacgacggcgccgcgccgaggcttccgtattgcgtgccgagccgccgcaccgcgaggctcgtgctgtccgcgagcgtgccgatccgcaccgcgaggtcgatgccttcctcgacgagatcgacgaaacggtcggtgatcgacacgtcgatccgcagatcggggtaagtgcgtgcgagatcgagcacgacgggcgtcacgcagtggtgcccgaacgcgagcggcacgctcaggcgcagcttgccgcgcggctcgttgcggccgcagtcgaggtcggcttccgccgcttccagttccgccagcgcgcgcacgcagcggtcgtagtacgcctggccgtcgtcggtcaggctctggctgcgcgtcgtgcgctgcagcagccgcgcaccgagccgcttctcgagccgcgcgaccgccttgccgacggccgaacgcgtcatgtcgagccgctccgccgcgagcgcgaagctgcccgattccactacctggacgaaggtcgtcacgccgtcgagtctgtcggtcatcggagggggattgagtcctgtggttccccagtctggagaaatgcctgcgtcaatggggatcggaattctcactatagtaccgattccggttcagcgtgcgttgccggccgcgcgcgacccatccttctcatctggaggcgcgcggcccgttgccgggccgccgcgcaatacgcatgacgctatccgactcccgcaggaatgcggtcgcgctcgcggccgtctgtctcacgtcgctgatgttcggcctcgaaatctcgagcgtgccggtgatcctgccgacgctcgaacacgtgctgcatggcgatttcaacggcatgcagtggatcatgaacgcgtacacgatcgcgtgtacgaccgtgctgatggcggccggcacgctcgccgaccggttcggccgcaagcgcgtgtacgtgaccggcaccgtgctgttcggcgcgacgtcgctgctgtgcgggctcgcgccgaacgtgccggtgctcgtcgcgggccggctgctgcagggcgccagcggcggcgcgatgctgatctgccagattgcggtgctgtcgcaccagttccgcgagggccgcgagcgcggccgcgcgtttgggatctggggatcgtgttcggcatcgggctcggtttcgggccgatcgtcggcggcgcgatcgtcgcgctggcgagctggccgtgggtgttcctcgtccatgcgccgctcgcggccgtcgcgctcgcgctgatcggcggcgcggtgcaggagtcgcgcgatccgcacgcgggcagcctcgacgtggcgggcatcgtcacgctgtcgctcgcggtgctgggcctggccttctacatcacccaaagcgcggaactcgggctgacgagcgctgccggcctcggcgtgctcggcgcgaccgtgctggcggtggccggcttcttcctcgcggaacgcgcgagcgcgcggccgatgttcgacttctcggtgttccggatccgcgcgttcaccggcgcgatcttcggctcgatggggatgaacttcagcttctggccgttcatgatctacctgccgatctggttccaggtcgcgctcggctacgacagcgtgacggccggcctcgcgttgctcgcgtacacgctgccgacgctggtcgcgccgccgttcggcgaacggctcgcgctgcgctacgggccgggcgtcgtgatcccgggcggcttgttcacgattgccgccggttttgcgctgatgcggatcggcagcgcggccgaccacgcgagctgggtgacgatgctgcccggctgcgtgatcgccggcatcgggctcgggctcacgaacacgccggtgaccaacacgacgacgggtgcggtgccgagcgcgcgggccgggatggcgtcgggcatcgacatgagcgcgcggatgatctcgctcgcactgaatatcgcggccatgggcttcgtgctggtcgcggggatcgtcgcgagcctgaagggcggtgtcgcgggcacgatcggcgacggggcgctgcgccggctcgcgcaggagattgcttccgggcgaaccgacgggctgcacgagatcgcaccggcgcttgcacaggccgacccgaccggcgcggtgttgcatgcggcgctcgtgcacgggttcggctgggtgatggtgtacggcgcggccggcgtggccgtgctcgcgacggcgagcgcggtggcgttcgcgccggcgcggcgcggggcggccgtgtgcgaatgacgccgcgcatggccggcggggcaggggcggccggcccggtgcgcgggccggtcaggacatcccgccgccgagcgcgcggtacagggtcatctggttgttgagccggtccagccgcgtctgttcgtcggcgctttgcgcatcgcgcagccgctgctgctggtcgagccacggttgcacggcggtcgcgccggccgcgaattgcgcggcggcaagccgctcggcgcgctgcgcctgcgccagcgacagcgcgcgctgttcggcctcgcgttcgagctggacgcgcgccgacagcgcgttctcgacttccgcgagtgccgtgtagagcttctgccggaacccgacgacggcctcctcgtactgcgtcttcgacaccttgatctgcagctgcatcgtgttccactggatgaacggcagggccaggccgagcccgagcgtgccgaccggattcgcgagcacgcgctcgaggctcgtgctcgacgtgccggccgcgccggtcagcgtgaaggtcgggtagaagctggtacgtgtcgcgtcgacctgcgcgagcgattcgcgcagcctgaattccgccgcgcgcaagtcggggcgccggccgagcaggctggccggcaggccggccgccacttccggcggcggcgcgtccggcagcgccggcggttcggccgcgcgttgctgcggtggctggtcgaacaggatcgcgagggcgtgacggttctcggtacgctgctggatcaggcgtgtctgcgcggcgcgttgcgtggcgaggctttgttcggcctgcgcaaggtcgagccccgacacggcgccggccgtgtgccgtgaccggacgaccgcgagcgtgcggaccgcatacgcgatgttcgcgtcgccgagcgcgatctgccggttcagaaagccgatccgccagtacagcgacgcggtcgtgccgatcagcgacagccgcgcggcttcgagatcggcggccgtcgcgtcggcttcccagcgcgcggcgtcgcgcagcgcggccagccggccccacaggtcgatttcatagctgagcgaaacgttcgcgttgctcgaccggcgcatctggtgcgtatcgagcgtgcgcgacacggcaccgttcgcgccgagcgtcacgttgggcgtcaggttcgtattcgcgagcccggcctgcagttgcgcgcggtacacgcggatcgccgcgatcgcgaggtcgttgttggcgcgcagcgcgtcgtcgatcagcgcgtcgagttgcggatcgccgaagctgcgccaccagtcgcgcgtcgtggccggtgcgtcggcggaaaccggtgccgaccagttcgcgggcatcgcgacggcgggcagcggatcatggcgcgcgcccgcgcagccggcgagcagcgcggccgcgcatgcgaatgcgaatgcgccgaggcgctgaagcggtgaggaatgcgtcatggcgggccttgcgtcagtcgcgcgcgagcgcatcgatcggatcgagccgcgatgcgttgcgcgcgggcatgaagccgaatatcacaccggtgagcgtcgagcagacgaacgcggtcacgatcgcgccggccgagaacaccatcttccactgcgcgacgaacatcgagaacagcgcgccgagcccgaacgacagcgcgatgccgatcgtgccgccgagcaggcagaccagcacggcctcgacgagaaactgctgcaggatgtcggactggcgcgcgccgactgccatccggatgccgatttcgcgcgtgcgctcggtcaccgacaccagcatgatgttcatcacgccgattccgccgacgacgagcgagatcacggcgatcagcgacagcagcagcgtcagcgactggccggttttctcgacggtcttcacgacgctgtccatgttgtacgtgaagaagtccttgcggccgtggcgctgcttcatcagcgtttcgaggctcttttcggcggcggcgctcggctgcccgtcgcgcacgcgcacggtgatgctgtcgagataacgctgcccgaagagacgcccgctcgcggtcgtgtacggcacccacacgttcaggctcttcatgctgccgaacgcgcttttcttgtccgccgtcacgccgatcacgacgcacggcacgttgtcgaccaggatcacttcgccgatcgggttgcgcgtcgcgccgaacagcttgcggcgcgtgttctggtcgatcacggccacctgcacctggcggcgcaccgcgtcctcgtcgaatgcgacaccgagcgcgaagcgcatcccgcgcgcctggaagaagcggtcgccgacgccgctcacgagcgcgttcacgtcgacgttgcggtagcgcagcagcagcgtgcgcgacgtttcgggcgtcgcgctgtcgacgtacggctgctcggcgagcgcggcgacatcggcgggcacgagcgtctggatcgcatcggcgcggctgtcgccccagtcggtgcccgggtagatgttgatcgtgttcgtgccgatgctgccgatctcgtcgagcatgtagcgcttcgcgccttcgccgatcgcgacgatcgacacgaccgacgtgatgccgatgatgatgccgagcatcgtcagcagcgtgcgcagccggtgcgacacgagtgcgatccacgccatccggcaggcctcggcgaagcgcccggagccggccgcgaagcggtgcgcgcgcggggcggcatcggcctgcggatcgggggcgactgccgcgggcggcgacggcgtgtcgtgacgatcgcgggcggacggcgcgccggtttccgcttcgctcgcttccgctgcatccgcgcccgcggctgcttccgcgagggcttccgcatggtggcggttcggccggtcggcgacgatcgcgccgtcgctgatctcgatgatgcgccgcgcatggcgcgcgacggccttgtcgtgcgtgacgatgacgatcgtatggccgagcgcgttcagctcgtgcaggatgcggatcacgtcctggccgcttttcgtgtcgagcgcgccggtcggttcgtcggcgaggatcacctggccgccgttcatcagcgcgcgcgcgatgctcacgcgctgctgctggccgccggacagttgcccggggcgatggtgcgcgcgatccgcgagcccgaggcgcgcgagcagctcgcgtgcgcgcgcgtgccgcccgcgcgcggcgtgccggcatagatcgcgggcatttcgaggttcgcggcggcatcgacgtgcggcagcaggtgatagcgctggaacacgaagccgaagtgctcgcggcgcagttgcgcgagctcgtcgctgtcgagcatgtgcgtgtcgcgaccgccgaccgtgtaggtgccttcgctcggatggtcgaggcagccgaggatgttcatcagcgtcgacttccggagcccgacgcgccgacgatcgcgacgatctcgcccgcgtggatcgacaggttgacgttgttcagcacgacgacgtccttgtcgccggccggaaagcgtcgtgtgacggcggagagtttcagcaggggctggctcatcgtcacaccacgtccgccagcggtgcgtggtcgtccgcggacgcctcgccgatcacgacgcgttcgccgtccttcaggccggccagcacttcgacgcgcacgttgttgttgatgccgatgcggacgttgcgcgtttccgtgctgccgtcggcgcgcagcacgcgcaccgcgtaggtgccgtccttgcgtttctcgccgagcgcggcggccggaatgctgagcgcgttgcgtgcgttgccgagcacgatgttgacctgcgcggtcatcgagatgcgcagccggtgctcgggattcggcacctcgaacaaagcgttgtagaacaccgccgaattcggtttcgcgccgccgcccgcgccgccgccgagtgcgctttgcgtctcggcgtagttctgcggcgccggctcgatcgcgcgcagcttgccgtagtggcgcctgtccggttcgcccaggatcgtgaaatacgcggtctggccggcgttcacgcggatcacgtcggcttccgacacctgcgccttcacggtcatcgtgtcgagatccgcgagcttcaggatcaccggcgcctgctgttgcgcgatcaccgtctggccttcctgcgtgacgatcgcgacgacctggccgtcgatcggcgcgacgatgcgcgtgtagccgaggttggcctgcgcggtctcgatctggatgcgggccgagcggatctgcgcggcgagcgacgcgagcgtcgcgcgctgcacgtcgagcgtcgcgcgcgcggcttcgaacgactcgcgcgacgtcgcgtcgtcgggcagcatggcctgctggcgccggaacgcgagttccgcctgcgtgagttgcgcggcggtcgattgctgctgcgcgcgcaggctttcttcgctggcgcgtgcctgccgcagcgcgttttccgagagcacggggtcgatctcggcgagccactggcccttcgtgaccttgtcgccgagcttgaccttcagcgacttcaactgccccgagacttgcgcgccgacgtcgacctgcctgaatgcctgcagcgcaccggtggccagcaccgcgttttcgaggtcgccgcgcgagacgggcgcggacaggtattgcggatgcttgtcgggtgcgcacgccttcagcgtgacaccggtggcgatcgcgacgatggcaacggtggccagcacgatgcgccggcggcgatgggtcttctgagtcatgagcgtgcggcgaggatgaagcggtgccggcgttgcgtgcggccgggcgggacgatccggccggcgtcgcctggcgggcgggttgcccgcgggcttccgcgtacacctcgcgcggccgtgccgggtcgaatcagccgctcatggtaagcgaggaattcacgacaaatcgtgtggaaattgtgctgaattgtacggacgccgtgcaggagcggaggccgggcggcgacattgttgcaatctgtcagcgcggcgggcgaaagctcgtgcgcgtgttgcggcgtgcgttatcgccgtgcggcgacgagggccatcatcggccggtcgcgttcctcgtcgagcgcgggcagggcatcgacctggtcctgcgtcggcccccattcgtccaggtgcgtgagcgtgaagccgctgccgatcagcaggttcacgagcgtgccgagcgtgcggtgctgcttgacaacgcccggcgcgagccagtcggtcacgcgttcgccttcgcgctgatagccgtcgagcggccacgagcggttgccctgcgcgtcgacgacgaaaccgggccggcgcggcgccgtatagaccggatgctcgatcgagaacacgagccgcccgcccggcacgagcgcgcgatggagcgtgcggaacaaggtatcgaggtctgcgatgtaatggaacgcgagcgagctgtacgcgagatcgaacgcggcatccggcagcgcgaacgtttcgaggtcggcgcggcggtacgtgatcgccggatgcgcggcgttcgatgccgcacgttcgagcatgcgctcggacacgtcgatgccgagcacgcttgccgcgccctggccggcggcccagcggctgaaccagccgtagccgcagccgaggtcgagcacgcggcgaccgtgcaggtcgggcagcagcgcgcagcgcgggccactcggggcgccgtcgagtccgtggatcgagcggttcaggcggctgtagccttcgaagaaggccgggtcgtcgtagatgttctgcgtcatgcgtagggcctcgtgcggacagggtgcgcggtgccgcgcacccggttccgcgagcttacgcgtgctgctcgcccgcgtcgatccggcgttgcgtgtcggcgtcgacgatgtcgcggatcgcactgaacagcggtgcggcgtcggtatagcggcggccgtagccgagattgaacgcgtagtcgaaatcgggtggattgctgccctgggtgtgctgcaggatcgtctccagcttgtcgaacgctttcgccgcgcgcgcttccggcgacgcggccgcttcgtattcatcccacagtgcgacgatctcgtcgcgctgcaccggatcgagcggcgcggtcagcgtcagcaggtcgtcgcgttcgtgcgcgctcttgtcggggtgcgcggcctgctcgatcgcggggatgtcgccgtgcagcgcctcgccgagatcgtggacgacacacagcttcagcagcttcagcgtgtcgatgccgggcagcgcatcggcgaatacgagtgccatcaggcacagccgccagctatgctcggcggtgctttccgcgcgcccggccgacgtgtggccgctgcgcagcacatccttcaggcgttcggcttcgcgcaggaacgcgagccgcgcgtggatcgtatcggggttcatggtcggtatccgtgcgatgagccgtcaagcgtaaggcggccacgcacggttcgtccacgcatgaaatatgcgcggggtcgtactacagcgtttccacgagccgcgcggccgccccgtccgacaacgtcatccgtgtccaccggcacaggctgccgcggatcggcacgacgcgcgacgcattcgcgccagtgtcgaattcgacgctcggcggccccgcgcgatcatgccagccgagcgtatcgagcgcggcttccatgcggacgatttccggcgtcgcatagcgccacagcgacgtgccgagcagcatcgacagcggttgcgagaattcggctgctcgcgcaggcgaacaggcgagcagccggtgcgtgaggtcgcacacgagatgcatgcggcccgcgctgcccgcgacgagccgcgcaagcgcgtgatcgcccgcggaatcgaggcgcgcggcgagcagccgttcggccgtcgcgcgttcgtcgggcgacatctgttgcaggccggcttcccagcgcgagatcgtcgattgcgccacgccgaacagctgcgccgcgtggctctgcttcacgcggtgcagcgcacgccagcgcttgagctgcgggccgagcggtggtgcgtgaagcggtgaggcagacatggcaatgctccggttgcggtcgtcgggtgcgctcgcgtgccgctgcctgccgtcacaggcgcaacagcggcgacgcttgtgccattacatgatccggaggccgccgtttgcctcgatcgcgatggctgcgaacggcacgagcacgatgccgcccagcacgagcaggccgtcggcggccaccgtgattggcgtggcgaggatccgcaggcccatgccggcgacggacggcgattcccggatgtacaccgagtaccgctcgttgaacggttgcgtggcgcccttgtccttcgcggcgaaaccctccgtcgaatagcgcttgccttcgatgtcgccttcgagcgcgaggccggctgtcccggcagtgaatccgtcggcgctcgcggcttgccgggcgtcgtccggcgcgtcctttggcaacacgatccggtagtggccggtgatgctgccgccgcgcgcatgaaagtcggcaaacgtcgtgtgcagcgatttccggtagccggacagcagcaccggccgcaattgcgccggcagatcgaagatgtagtggtagttcgtgccgaggacgaccagcttcttgccgtcctgcgtgatcatgaagctcgtgacgtattcgctgtatgcgtcgttctcgtacagcttcggcgtgaagcagcccgacagcgcgagcgtgctcgcggccatgccggcggccagcaagcgccggcgcgtgatcgatgttttcatggattattgtcccgtctgatgcggtttggtggcttgcgccctcggaagccggattctggcgtatccgccgcgcgttgtcgaacaggaaatctgcctgggcagcgctcgcaatccggccctgtccagcggcatgctgcgctctccagacccgccgccaacgttttcgtcgcgctttcaaccgcctccgccatatcttattattcggccagtgcggaggcgtaccggccgccaacggtcatgtcgaggcatgacgcgccggcacgaatgaccgcttttcggcctgtgcgtcgctcgatgcgcggtcgaaacgacaggacccgcgtggccagcgcgtgtcccaaaaatcacgagagggcgcgatggtacgactggtcttactgctgctgggcatcgaatacttgcgcacccgctggcgcgggctgaccgcacttggctgggtgtgggtcgtcgcggggtcgtgatcttcgtcgacgcgctcgacggcgcgctgcattttccgatccagatcttcgcgtggctgttcctgatcgaggggctcgcgacgctcgcggtggccggcagcggcgtcggcgggcagcgcgtcctgcgctacgtgaagggggcgcggtcgtggtggccgccgggctcgtgttcgcggggcatcaccacggccatttcctgctgtcgatgatcttcggcacgctgttcctcgtcgacgggctgctgcagtgcaccgccgcgtggatggtgcgctatcgccgctggaacgtcgccttcgcgtggggcgtcgtcgagatcctgctggcgatcttcttctatcagccgtacccgacccactatgtgggcaccgtgccgtactgcctcggcctgctgctgatattcggcgggatgcacatgctgagcctcgccgcacgcgtgcggcgactgacgcgcaatccggcgttcgcgacctcgccggcgccggcactcgcgccggacctcgacgatgcgcgcgacctgccgcatttttcccaatccgaatgggacggcccgcctgccgacggcgagcatgcgctcaccgtgcacgtgtggacgccgaccggcacgtcgaaagccgaagcgcaacgctaccccgtgatcgaccgctatatcgcggcggtcgacgtcaacggcgtgatctcgaccgggcacgcggcgctggaatcgccggagggcatctatatcagcctgtatccgggcgtcgaaatcgatcgttctccggacgaattcacgcgcatcctgcgtgcaacccgcgaaaacgacgtaccgggcctgttccagcccgactacgcgaccgagtcgaaggcatggtgcccgtcgaccgtgcgcgtgcggatccgcaactacgatccggcgaagctggacgcgttctggtcgtcgtaccggcagaacgtgacgtacaacctcacgcaccgcaactgctcgagcaccgtgtcgaacgcactcgaagccgcgctcgacggcgcggtgtggcggctgaagggcgcgcgcgccggatggggcgcgttcgtgcggttgctgctcacgcccgagctgtgggttgccgcgcagatccgcaagcgcgcggtgacgatggcgtggacgcccgggctcacgctcgactatgcgcgcgcgctcagcatgcttgccgacccgcggccgttcgcgtggtggaaggtcgcgcgctcggccgtgaaggcgatcatggcgtcgcgccgcacgtggcgcgagcaggacaacgcggcgctgtcgccgggcggatcggaggccgcgtcgttgaagtgaccgcgtgccgccggacgagggcccggcgtcgctgaggccgccaccgcacgccccggcgatgttgcccgccacaagaacccacagatacgaacaacaatgaacaagacgagcgcattccgcatcctgattcccgccgcgctggcgctgacgagcgccggcttcgcgcaggcgagcgtgaacgaagtgccacgcatgagcgacgacgtgtaccgcacctcggtgtcgttctgctcgaacgtcgcggccgcggagaagatcgcgtgccagggcgacatgatcgccgcgggcagccggatcgtcgcggcgatcggcggcctgccgccggcatccgccgcgtcgatcgacgaaggcgcgcgcaacaagctgccggcggcggagcgcagggctcgcgcctgtcgagccgcgcgcgatcgacaaggacgacgatgttgccggtctcgccggcatggtgcgcctgtgcgacgtgtacgaatccgaaccggcatcgcgtgcgcggcatcacgcggcgttgaagcagcaggcgccggatgcggcaccgcgcgtcgaggcgttgctggccgatgcgtcgacggcggcgcgccagcgcgtcagcatcggcgtgtggcagattctcgcactcgaaggccccgaagcgtccgcccgcgcgtgcacgcagctcggcaccgggtcgtgagtgcctgttcgccaccgatgcttgtcgcgcggccgtcgacgtgcgggtgtcgatcgtgccgtgtccggcgcgccgtgacggtcagccgctcgcgatcgtggccggcctgacccgtatcggcttgccgagcgtccgggcgaccggagaagcccgcaccgcgtcgcgcacgagtgtctgctgcgcgtgcgacagcggcgcagcgaagcgcagtgcgatgtcgaagcccgtttcatggtcgaggcgatcgacggtgacgtccgccgtgcacgcgggcagcgtcacgcccgcgcgtcgtgcggccaggtcgatcgacatgcagacgcaggccgcgagcgcgctttcgagcagttcgtgcggccgcatgccggcgtcgccgccctggccgtccttgtgcgtgtccgagcgcacgacgctgcgcccgttgccgatctcgacgcaatgtggcttgccgagccgtgtcgcggtcaccatggcgatgctccgttgcaggatgagggtggcgacacggtacgccggcgtcgcttgcggcggaaggcaaccgctggtaccggtaccggttgtaaccggctcggcggcgacccgcgcattctttcgtccaccttcacattcgtgccatgttgcgacggcgacaatcgcggtcggacattcgacaaccgtgcggcgcatcccgcgaccgcatgcctttccgaggaaacacgccatgctcaagacgctcgcccgcgccgctgccgcactcgccgttgcttccgtgtcgctgcacgccgccgcgcagaccagctacgactacctgttgctcgccgcatcgtgggagcccggcttctgcgcgtcgcacgacacgccggaatgcacgaacctcgccggctcgtatgcggcgacgagcctgtcgctgcatggcctgtggccgaaccgctatgacggcaaccagccgttctactgcggcgtgccgcagaacgacatcgacctcgacaacgcgcaccagtggtgcagcatggacgcctacccgatcagcagcgcgacccgcaacacgctgtcgacctacatgccgggcgtcgcgtcgtgcctcgacaagcacgaatggttcaagcacggcacctgctcgaactcggcgacgcccgatgcctactggaaccaggcgtccggcatgatcagccggctcggcaacacgtcgttcaacgcgttcctgcaggcgaactcgggcaagacggtcacgcgcaaccagttgctgtccgcattcgaaggcgcgttcggcagcaacacgcgcagcgcggtgtcgctgaagtgcacgaagacgaatggcgtcagctatttcaccgaagcgtggatcgcggtgaagaccaatgcgaccgcgcagttcccgagcgccgcgtcgctcgtgaccgacggcaatacgcagggcacgtgcccgacgtcgggtgtgtatatcgcgaagtaacgacgaagggggcggcgcgcgcggcatcgcgcacgccgtcgcccgttacgggttcggcgggacgctcgaccacggcagccgggcctggtagccgtcacccgtgcaggtcgactcgggtgatgacgttggcccgtcacgctcgcgcgtgtgcgtgcgcttacgcgagcagccgcaacgcgtcctcgagcgacagcaccgtcgtgcgcgattcgaaggcggtggcgaacaggtgctcgtgaaccaccgggtccgggtcgtagcagcaatccttgaccgtgtagaggcggaagtccgcgtcgctcgcgtgggcgatcgacgacagcatcacgcccgtcgacgcgatgccgaccatgatcagcgaatcgacgccttgctcgaccaggcgcgcttgcagatcggtaccgaagaacacgctggcgcggtgcgcgacgatcagcggctcgtcggcctgccgacccaactccgggcatgggccgtcgtcgatgaagcggccgagctgcttgatgccctggccgttcttgttgcgcgggctgacttccggatagccggggctgaaccggaggttcgcgaaccagacgccgatgccgcttgcccgcgctgcgtcgcagagccggcgcgtattgacgagcaaaccgggcgcgaccgacggaaagaggccgaggatgtcggtctggtaatgcatgacgagcagcgcggtgcttgacggcacgatggcgggaatcggggcggccggggtgacgccggggttcgtgcgggttgccgttgtggcgacttccggtgcgttttgccgagtcatgaacgagggtctccgatagctcgcggggaatttcagcgtccccgatttgtaccggaaaatcggggtggttgccgatgcgattttcgtaggggcatgttgctgcgtcgcgcggtggtcttcgtgataccggcgccacgtttgtgcgcagccgcaattagagaccaatggtcggtcgcggtagtgcgacgccgatgtcgatgatggccgattgcgagtgcgtgctgctgccgttcgttcgcggtgaatctgaaaccggtggcgcatcagcacggcccggatctgcgcgagggccgacacgcatcgtcgcacgcgacgccgctgccagaaaggaggtgtgaatacgcccaacggcaacatacgtatgcggcgaccgttcaaactgaaggaagtgtcgatatgcgttcgatcgacatcgtgtccgttgctgccgaaaatatcggcccattcgtcgcgggcgggccggacaagccgctgccacggcaatagttgtccttactcctgaccggggtgcgcagtacgctcaccgacttttcgatatccccaaagagcgtgagactgccgtcctgctccatcgataccctaatcgttttcccgcgaggtaactcgtagtcacccacacgttgatctacggccgagatgcaggagagctgtttgagcgtgtcgtattcaaatgcccctgcaccacattcaatgccgaaaattttccacgagtggggtagctctcccgaaatcgactctgagacggtgccgtcgacagcgtgcgccttgacgcgggttccagcagggagatcgagttcgcggtctcgaaacccggaggcaagcgtgcactccacgttgtccagatattttcgtggtcgaagaaggtgcgctccttatgatgtgtaaattggccgggtgcacactcgatcccgccgatcgacgccagcttcgcaagcgtcccgtaataaatgtagctcgtgctgtcgtcggaacgtagcacgtagaagtcgccgctcacgttcagtccgagaagcggtgtgttcgacgggacggtgccgcttttgaccgaatggggtgaattcacttcgagaacgaccgttgagccaggcggaaacgtcatcccgtcaaataccgttgcccgtgtgaggtggtgggtgtaccaggcgcttatagcatggtcatagctgtcagcaattgaacgatggttggcaaatgcgatagcctgcacgaacaccaggcagcagagaaatacgacgccgcgtctccatgtcttatgcgctcgaacgcgactgtttaacccgaaggccgcgacgatcagcgtgaccggtatggtggcggcaagcgccagaaaaacaggatcgccaagtctgatatcccgtataacgccacaatcgagtctccgtttgatcagtttctgccacgatcctcgttgaagtgctgtccatatcgactagaccctgatgtcgggcagatgtgcagcgagcatagcttatgtgtcggggccgctattgaaaacaccgtggtccgggcgattcgccaagcgtgcgttgcttatccgcacgcttttggaatttcgattgtgttaccgcttttgcagctgaattaaccatgtctgacttcgcccgcctctaaaaatcgaccgccccgaataagtcgtcaactactccaacaccagcgtccccgtactccttgaatgtaaaccgatggcgaccggatcagaatattgaaccactggtgcaggttgccaattgctcaagcctctgagcgcatgtgttcaggaaatatggctctcatgtgattccttccgctcagaccggacgggcgagcggcacgcctcctttggcgtccgagattggccgcaagagagccgctcaccgacgtgtcaggattgtcgacaatgttgcggaatcgataaacaaatgcgtcgggttgaaagtagtgcgatcaggcattcgtgaccttcgccgctgtcacggtcacctcgaccagccagccgggctcgacaagcccaactacctgtgcgcgagtccggaccggcaggttgggttgcactgccgaaccaaaatattcagcatagacactcgaaaaacgctcgtagtccggagcaccgccgctcgctggatcagcgacgaaaagcgcttgcacggcaatcacatctcccaatgcatatccttttccttcgaggattcgctggatttgatccagcacacttttagtctgtgtttgtatatcaccgaaatagtcgatcgtgtgcggctcggcatcgagattcgacggcagtgcgcctatcccgctcaacgtaatggttgtcgcgcatgcagggatctcgattgcttccgaaaattcgcgtgcccacgattcttcgagatacgcgggagtagggtgccgcacaatggtgacgctcatcaggtgctccagaggtgagactgacggttctggtgccgtcagttgaattgcctttccgtgacgtacatctgccacttgcgacgagcccgctcgttgtcgatgcggatatcgaggctgtgtcgacgggtaatgatacggaggtatcgatgatcggaaaaatgaattgattcgataaaatcattcgacagtgtcgatcgatgctgttgcgtcggcctaagcccactgggagacatatggaactgcgccaccttcgctattttctggccatcgtcgaactcaacaacctttcccgggcggccgaaacaatgtgcgtcgcgcaatccacgctatcgcacgcccttcggcaactcgaagaggaactaggaattgctctgttcgatcgagtcgggcgtggcattcgccttacacaggctggccgggtttttcgcgactatgccgcacgcacttgcaatgaaacgatacgagcgagacgtgccctacaggaactgaacgagctcaacgcgggcacctttaccttgggtgcgatcccgatatttccgctgtcatttttacctcgagcggtctcgtcctttaatcagcagtatccgagggtccggatcgtagttgaggatctactcgcaactgagctcgaggagaaactggcactcggaacactcgatctcggtctcgccttccatccagcttcgcgggacgatgtcgaatccgagtatctcttcacggagcggcttgtccttgctgtcggccggagccaccccttcgcacagaggcgccgggtccaatggaaagcgctcgattcaattcccttgcactgctgacaccaaaattctcgacgcgcaccctgatcgaagaggcgttcaaaactgtcggcgtccagtcgagggtagtcgtagaaatggataccacggagtcgcttctggcagttgccgcagaagggcaacttgcaactatcgttccggaacgtgctggttccggcttcgaacgcgtcaacttgatacccataacgcatccggagttgtctcgaaaactcggtttattgtggccgaaaggaacggggcgaacccgtgccgcaaccactttcgcagacgtgctgaaagccgcgtccgcaaacccgcggcgcgactagaaaacgtaatctgtggccgagtcaatcgggtctgcgacaattcgcacgtggtggcgctttgtcgctacagctcagcatgctccgatagccggacaatacaagggcaccttccaagcccatgtcgaatgaccggtaccgggcaagccatgtgactgtttcggagcgattgctgccaatggccgaattccgaaattgagcgggccgcgcagatatgaatcgaccgccgttgtgccagatgaagcgcgcttatgctcagcacctcaaaaatcgaccgccccgaataggtcgtcaaccactccaaagctaaagtccccgccaacgagttcccattagcatcgagccccggcgcccacacacaaaccgccatttcccaggcagcaccgcaacgatcccgccaccgacaccactcttcgccggcaacccgacgcgatacacaaaatccccgccgcatcgtaagtgccacaggtcagcatcaacgccgacagccgcttggcggaactcgaatccacgatccgctcgccggtcaccggcgcgaccccgccattcgcgagaaacagcgcggcgcttgccagctcgacacagttcatcgtgatcgcgcactgtcggcaatacgcatcgatcaccgtgtcgggcggcatctgcatgttgccgaagctcgccatgaagtgcgccatcgcgcggttgcgctccgcgtgctgcagttccgactgcgcgacgcgcgaatcgtagtcgatgtcgttcgtgccgatcagccgccgcacgaattcgacgagcgccgtctcggccttcacgaagcggcggcacagcacgtcggtgacgaccagcgccccgcattgatgaacgggttgcgcggcttgccgcgctcgctctcgagctggaccagcgagttgaacgcgttgccggacggctcgcggccgacccgttcccacaggtcgtcgcccagcaactggaacgcgagcgtgcacgcaaacagcttcgagatgctctggatcgagaagcgctcgtgcgcgtcaccgactgtgcaaacgtttccgtcgagtgtgacgacggccattccgaacttgtcggcgggcactttcgcgagctcgggaatgtaatcggcgacccgtccctggccaatccaggggcgagttcggtgtggatgcgttcgaggatcgtttgataattcatcaagtcaggcgggcagggcatggcccggattcaggcgagcccgtatggaaccgtcccggcgccgattcgtcaagctcggccgatatcgctcccttattttcaagaccgctaaacaggcaatcggctggcgcagtatcatgcggtacgtttcggccaatggccggcgtccggcaccggccggcgccgccgcggcttcccgatgaaccgaccgctgcccatgtcttttcgcatcctgctcgtcgaagacgacacccgcctgtccacgctgatcgccggctacctgcgcaagaacgactatgaagtcgacactgtgctgcatggtgacgccgcggtgccggcgatcctgtccattcgtcccgatctcgtcattctcgacgtgaacctgccgggcaaggacggcttcgaaatctgccgggaggcgcgcaagcagtacgacggcgtgatcatcatggtgacggcccgcgacgagccgttcgacgagctgctcggcctggaattcggcgcggacgactacgtgcacaagccggtcgagccgcgcatcctgctcgcgcggatcaaggcccagctgcgccgtgcgcccgcgcgcgcgcccgagagcagcgcgccgcagcccgaacgctacgcgttcggcaagttctcgatcgaccgtaccgaccgctccgtcgtgctgcccgacggcagcacgcccgacctgacgtcggccgaattcgacctgctgtgggcactcgtgtgccatgcgggcgaagtcgtcagccgcgacgacctgatgctgcagttgcgcggcgtcgagttcgacggcctcgaccgcacgatcgacgggcgcatctcgaagctgcgccgcaagctgcgcgacgacgcgagcaacccgcagcggatcaagacgatccgcagcaagggttatcaattcagcaagcacgcgtgggaatgacgcggccttcgggcgacgccgtcacgttccgcgcgggcattcccctgccggccgggagccgagatgatccgacgaacccgttcgcaccccgatgcaccgccgctgccgacgctgcgctacgtcaaatggcgctggctgcatttccgccgcgcgtggaccgatacgcgcgccgaccgcattccgagctggtcgcgcctttacgtgcgcacctacctgcatctgctcggcctcgtgctgctgaccgcgctcgtgccggcgctcgcgctgtgtgtcgaattgtcgccgcaggtcgtgtggcatgcgttcgattcgctgcccggcgacatctggatcgtgctcgtgttcgtgttcgccgcacccgcgctcgcggcgtaccggtggatgcggccggtgtggtcggatctcgtgatggtgcgcgagcgcgcgatcgacttcacgggcgggcgcttcaacacgcgcgcgcgcgaatcgcacagcgtgatcatcggcccgctcgcacggacgctgaatgcgctcgcgatgcggatggaacgcctgatcgccgcgcagcgcgacctcacgaacggcatctcgcacgagctgcgcacgccgctcgcacgcgtgcgtttcgcgctcgaaatgctgcgcgagccgggttccgcggccgaataccagagcgcgctcgagagcatcgcgcaggacgtgaccgagctcgaggaactgatcgacatgagcctgacgttcgcgcggctcgaatacagttcgctgcagtcgaacctcgagatgacggctcccgtcgcgtggttcgaacaccaggtcaacgatgcgcagctgctgtatccggaacgcgcgatcgagtcgcgcatcgcgatcgcgtcggacctgcgggtgaagatggaccggcggctgatgtcgtacgcgatgcgcaacctgctgcgcaacgcgagcaagtacgcgaaatcgcggatcgtcgtcgggatctcgctcgtgcacggcaacatcgggatcttcgtcgaggacgacggccccggcgtgccggagagcgagcgcgagcggatcttcgacgcgttcgtgcgcctcgaccgccgcaccggcggttatggcctcggcctgtcgatcacgcggcaggtgctccacgcgcacaacggccggatcgcggtcgtcgacccggtggaactcggcggcgcacgcttcgagatcagctggccggtctgacgatccgcaacacgagtcccggggccccgggactcgacagcaaccccgcacgaccccacgaccccgcgacagccgcgcgcgccggattcgagcgcgtcgccggctcgtcccgccgtccctgacccgtaccgcgtaccgatgtctgcccgtaccgccaccccatgacgattcgtttggcgcacgtgcgcgctttgcattacgattgcaattgcaactgtgtgggcgggccgattcgtgtcagtggaggcgggcggcccgcgacgcagccgtgaagccggggcagccccgatggccgctccgttgttcatgcattcctgtcagggtcatacgtcatgcggcttttgaatatcgtgtcatctcccgcggcgcgaggtcggcgtcgatcgcggtcgccaatgccttcgtcgatgcgttccgggaaacgtgcgcgtcgatcgacgtcgatacgctgaatgtctgggaagaagacttgccggacttcgacagcgacgcgatcggcgcgaagtacaagggcgtcgccaacgcgccgatggacgacgcggaacagtcggcctggcggcgcatccaggcgctcgtgaagcgctttcaggaagcggaccggatcgtcgtgggcgtgccgatgtggaatttcggctatccgtacaagctcaagcagctgatcgatctcgtcagccagcggaacatgctgttcacgttcgacggcaaggcctacgccccgctgctggagattccgcgcgcgctggtcatccatgttcgcggacagagccgggagacgggcgcgggcgcggacaatcccgggttccggcatcaggccgactacatcgaattctggttgaggttcatcggcgtgagcgaggtcaggagcctgaccgtcgaacacacgtgggggcgcgggcgagcgacagcatcgaacaggcgcaggcccgggcggtcgcgatggccgcggcgttctgatccgggcgtgtcgcgcgaaggcgtggcggatgccgccgaagcggcacccgcgcatgctcagtacgtgcggccgagctggaggtagaagttgcggcggccgccgggcccgagcgccacgccgaggtagaccggcccgaacgcggtcgacaggctcgtgaagaacgtatagctctgcttgagcgagccgccgccgatctgctgcccgctcgaccagacgttgccgacttccgcgctggcgcccaccgacagcgccttgatcggcgatgcgttgaacgtcatcagctggttcatgtaggtcacctgcgcatacgcgagctcgttgccgttcagctggtcggccgcatacgcggacagatgctggaagccgccgagcgtgaagttgaacgcgttgttcaggttggtgccgccgatgctcttgccgccttcgatcgtcgcgctgacgctgtggctgccgaactgctgcgccaccatcgccttcccgtagatctcggtgtagggcgcgctgttgatgctgtcgtcgaattcgctcgccgagcccccgttgcgcgacaccagcgagcgctcgatgcggaactcggtgaaatagcccttgcgcgggaacagtggatcgtcgagctggtcgatgacgagccgcgcacgcgcgatcagcgcctgcgacgtgaagctcggccacagcagcgtctggccgctgccgtcgtcgaacggggacggcaggttgtaggtcggcgaaccgtgcccggtcacgtacccgatgccgatccggaaatcgccgagccgcgcgatcggcaggccgaggtcgatcccggcgcgcgcggtctgcatcaggtactgcgtgatcttcacgtcgccggagtcgtcgtacaggttcgcgtagcggcgctggtattccgcgtagggcgacagatagacgccgtaggccatcgacagcggctggcggagttcgacgcgcgccgattgcaggtcgctgccgatcgtcgtgtccgcgcggaattcgagccccgattcggtgagccacgggcgccggtagccgacgtgcaggcggaagccgccctcgtcggtcgagctgctcgacatgccgagcccgaacaacaggaaattcggccccagtatttctcgcgggcgtcgatctcgagcacgttctcgtcaccgtggctcacgatctgctgcgtgacgctctcgaagttgccgcccgtcgtgaggccgagcagatcctggctgacggtgttcggatcgtacgtgtcgccgggcttcacgtgcagcgcgttgctgacgacccgcttcggcacgccgccggaggtcttgatctcgatgcgcgtgatccggatcggcggcggcagcggttgcgcgtgcgcggagcggtacgccgcatattgttccggcgtgagcgcgaagcgctgcagcttcggcagcgccgcggtcgcggcggccgcgccggcggcgatcgcctgcttcgcgttctggaaatcggtgaacgcgagcgagccgagatccggcgtgagcagcacgtcctgcgcgtcgagctgcttgcgctgggcggtcacgttctggcggatcaggatgccgaccatctgctgcatcacgtcggcgggcgacgcgagcgcgtcgagcgggcgcagttgcgaaccgatgtcgaccgcgatcacgacgttcgcgcccatctgccgcgcggtgtcgacgggcaggttgctgacgagcccgccgtccaccagcgcgcgcccgttgatctcggccggcgcgaacaggcccggcatggccatgctcgcgcggatcgcgagcggcagcgagccgtggtcgagcacgaccatctggcccgtctgcaggtcggtcgcaaccgcgcggtacgggatcggcaggcggtcgaacggctggttggtgggcacggcggccgtccagttcgcgagcagcgcctgcagccggttgccctgcacgaggccgaccggcgccttcacgcctttcttgccgaagccgagcgttagcccgttgatgtacaggcgttcgtcctcccggctggtttgcggcaggtccgcgcggtccgtcacgtcgaacgcgatgtccgcgaggttgacctccgacagccgcttctgcatctcgccggcggccatgccgctcgcatacagcccgccgaccacggcacccatgctggtgcccgcgatgcagtcgatcgggatgcggttgtcctccagcaccttcaggaccccgagatgtgcgtagccgcgcgcgccgccgccggacagcacgaggccgatcgacgggcggccggccgggccgccgtcggcgtcgcaggtgtgcccggatgcggcgggcgtggcagccggcgcgctggcggcggtggccggggcggcggcggattcggggccggcagcggttgcgcggcgaccgtgcagcaccagaaggcgacgagcgtcgtgcaaagcgggcgcacccgcgcccagcggaaggaaacggtcgctgtcatggtggaaatacctggcgtgatcgggcgtctgaggcctgccgggagcaggcaagaccgagagattaccgtgttttacagacgcaatgcgagaggctgtggcgtagccggatgtgtctggaacggcacatttgacaattgcgtcgcgaaaaatcatcggaattgcctaaagtatcggaacgatttgccgctaagtccgtgatggagcggcatggccgcgccacggaaatgcggcgcggctgccccgcgtccgttcgattacaaaggtttgatatgtcgacaccgctgttcggaaagttgtttgcgcaacccgttgcgatcgaccctggaacggcaagtacgcggatttatacgcacgaacgcggcgtggtgctgaaccagccgtcggtcgtctgcttccgcaaggccggtgcgaccgacgcacgtccgacgctcgaggccgtcggcgagctcgcgaaggcgctgctcggccgcgaaccggggcatctcgaagccgtgcggccgatgcggcacggcgtgatcgccgacgcgcacgcggccgagcagatgatccgcagcttcatcgacatgtcgcgcacgcggtcgcgtttcggccgccgcgtcgaggtcacgctgtgcgtgccgtccgatgcgacggccgtcgagcgccgcgcgctccgcgaggccgcgttcgcggcgggtgtatcggaggtcgaactgatcgaggaatcgctggcggccgggctcggcgcgggcctgccggtgaccgagccggtcggctcgatggtcgtcgatatcggcggcgggacgacggaagtcgcggtgatcgcgctcggcggcatcgtctaccgcgaggcgatccgcgtcggcggcaaccagttcgacgcggcgatcgtcaaccatgtccgcaacctgtatggcgtgctgctcggcgagcagacggccgagcacgtgaagcagtcgatcggctcggccaccagcgcggtgccgcgcaggtcgacgcgcgcggtcgggcgcagcgtcggcgacggcctgccgcgctcgatcgagctgtccaaccatgacgtggcggacgcgctggtcgcgccgctcaagcaggtgatcggcgcggtgaagtcggtgctggagaacgcgccggccgagctcgtgaccgatatcgcgaatcgcggcgtggtgctgacgggcggcggcgcactgctcgcggatctcgagcgcctgctgtacgacgagacgggcctcgtcgcccggatcgccgacgagccggccacctgcgcggtgcgcggcgccggcgaggcgatggggcggctcgcgatgtgcccggtcgactgattcgggccgggccgtgcatcgcggtacggtcattcacattctttccatctccgtaaatctccgcaggtttctctttccaattgcctgcccgcttcgccgggcacgctgctccggccgacttgccgggaggctggccatcgtccggcatcggtccgccgcgtggacacccgaacgcgcaccgtgctagcgttacgcgcccgcgcggggccgggcaagccgaaatgcccggcgagcctgagcccgacgacctgagagaccgaaaaccttgaaaaaccgcaccaaacggggcttcttcgcccgaacgggccgcctgctggccatcgttgcctgcctgtggatcgtcgcagccgttgcgctcgtcgcgcacgggctgcggatgccgagcgagccggccgacgttgccgtgatcttcggcaatgcgctcgacgcgaccggcgcgccgaagcccgtactcgccgccaggctcgatgtcggcgtgcgctgctaccgcacggggcagtgcccggcgttcctggtcagcggcgcgatcgacggccccgggctgaacgaggcgaccgcgatgcgcgactatctggtggcgcgcggcgtgccggccgaccggatcgcggtggacgaccaaggcgacaacacgctcgcgacggcgcagcacacgctcgcttacctgcaggcgcaccgtgtgtcgcgcgtgctgatcgtcagccagttctatcacctcgcgcgggcgcgcctcgcgttcgagcgcgtcggcatcgcgcgggcgaacatctccgccgcgtatccggcccgtttccagttgcgcgacatctattcgagctggcgcgaagtgccggcctacgcggtgtatgcggtgcggttgtgggtgaaccccgatgcacggcccgtctcgttccggccgatgctttatctgatacggcagttttcgtcacgcggtgcgggtcttccggtcgacgcgtgacgaacatcgacgtaaccctggaagtgccggacgtttcgtctgatgaatggcggcgggtggattatcgtgcatcgatcctttccgggcatgtagatattgcattgcaaaaatctggccgcgataatcgcgtggatatcggtgttttcacggatgcgtcattttcgctgctgtaaataaatatccaggaaattggcaaaaggaatgcggatttacctgtaagacgcgttccgataagtaaaaatgcgcgcccgccggacctcgatcaaatggggaaaagatcgactggaaaagcctgtttttgatatagccttgtctgacaaaagcagggcggtgatcaaatcaaccagaaaatcgctgcagaaaacaggggccatcgacatgtcattcggctagtttcacgcctgccttcccgggccaattaaagattcgtccatgaattaaccgacgtcgcatcgcgacagccgggcggacgctttgtccgcgattttatgctggcggccgttcgatttcacggtaataccaattccaataacgaggaaagcatgaatcttgcgcgttcgaaaaagccggcgaaccgtttccgagattgctgttgccgacgggcgttttcctggcgttgtccggcgccggtatcgtgcccgcccaggcgacctgcagcacggcaggcacgacggtaacctgctccggggtcgccaacccgcttgcgccgagctatgcgaacagcgcgaacaacatccacgccaccgtcaatcccggtgcgagcgtcggcgtgctgctcggcgtcggcggcaccgcgatgtcgctgaccggcaacaacaccatactgaccaacaacggcacgatcgacccgtccgcgctcggttccgggctcggcgtgctgtcgagcggtgcggtgatcggcaatgcatcggcgagcctcggcaccagcgtcaccaacaacggcacgatgaacggcacgaccggcgtggcgatcagcggcgtgacaggcatggcgctgtcggtccagaacggcacgggcggtacgtcgacgatcaacaacaccggcacgatcggctcgaacccgctggtcggcgcaaccctcgtcggcgcggacgcgcccgtggtggccgcgtacggcggcgccacggtcaacatgacgaatagcgggacgatcaacggtcgcgtgtcgctcggctcgaacggcacgcccggccagggcaatacgtttaccaactcgggcacgatcaacggcggcgtgtcgatgggcgcgaacagcaccaacacgttcaatgccgtgacgggttcgtcggtcaatacggcgggcggcactggcggcgggttcaacatcacgatcggcccgaacacgatcaacgtggcggcgacgggcacggtcgacggcggcgcgggcggcgacaacacgctcaacctgaagcagggcaccagcgcgaacggcacgatcgcggtcaacaactacgtcaacttcaatcacgtcgacgtccaggccggcaactggacgatcaacggcgcgtcgaccgcgcaggacacgacgctgtcgggaggcgtcgcgatcatcggcaacaacgcgtcgctcggcaccggtaacgtcacggccaacggcggcgcgctgcaggcgggtaccgccgggctcaacgtcggcaacaccgtgacgctcggcgcgggcgggctgacggtgcagggcgcgaccgggctcacgctgtcgggcgcggtgacgggcggcggcgcgctgacgaagaacgacggcggcacgctgacgttgaccggtgcgaacagctacacgggcggcacgaacctgaacggcggcggcatcgtcgtcggcaacaacggggcgctcggcagcggtgcgctgaacgtcaacggcccggcctcgctcgactcgagtacgaacacgacgctcgccaacaacgtcaatctcgccaacggcaccacgctgacggtcggcggcagcaacaatctcgggctggccggcaccatcaacggcaacggcggcatcgtgaagaacggcgcggcgacgctgacgctgacgggcgcgaacacctacaccggcgacacgacgatcaacagcggcacgctcgcggtgggcgcgggcggcagtctggcctcgaccggcaccgtgaacctgaccggcgccggcgcgacgttcgacgtgggcggcgcatcgggcacgcaggcgatcggcgcgctggcgggctcggccggtaccagcgtgaacctcggcggcaattcgctgacgctgaacggcaccgtcaatgcgacgtacgccggctcgatcggcggcgcgggcggcatcacgctctccggcagcggcacgcaaacgctcacgggcacgaacgtgtacacgggcggcacgaacctgaacggcggcaacctcgcggtcggcagcaatacggcgctcggcatcggcgcggtgaacgtcaacggctcgtcgtcgctcgatgcgatcgccaacgtatcgctcgcgaacaatgtcaacgtcgccaccggcacgacgctgacgctcgtcggcagcgccgatgtcggcctgagcggcacggtctcgggcggcggcggtctcgtgaagaacggcgcggcgaccgtgacgctgtccggcgcgaacaactacgccggcggcacgacgctgaatgcgggcggcctggtgctcggcaacaactcggcactcggcacgggcgcgttgaccgtcggcggcgcggcgacgctcgatacgagcgcgaacctgtcggtcaacaacgccgtcaacctcgccaacagttcgacgctgacactgggcggcagccatgcgctcacgctgagcggcggcatttccggcgcgggcgccctcgtgaaggacggcgcggcgaccacgacgttgacggccgcgaacacctacacgggcggcacgacgatcaacgcgggcacgctggcgatcagcggcggcggcagcctggcgtcgaccggcgcggtgaacctggccggcgcgggtgcggcgctcgacctgagcggcgcgaccggcgcccagtcgatcggcgcgctgtcgggcgtggccgggacgaacgtcacgatgggcaacggcgggctgacgctcggcggaaccgccagcagcaccttcagcggcgcgatcggcggcgccggcagcctgacgctggccggcaccggcacgcagacgctgaacggcgcgagcacctactcgggcggcacgaacctgaacggcggcagcagtgtcgtgctcggcaacaatgcggcgctcggcacgggcacgctgaacgtcgcaggcgcggcgacgctcgacacgaacacgagcctgtcggtcaacaacgcggtcgatcttggcaacggttcgacgctgacgctcggcggcagcaacgcgctcacgctgaacggcggcattgccggcgcgggcggtctcgtgaagaacggcgcggcgaccacgacgctgacggggacgaacacctacaccggcggcacgacgatcaatgccggcacgctcgcggtgggcgcgggcggcagcctggcggcgaccggcgcggtgaacctggccaacgcgggcgcggcgctcgacctgagcgctgcgacgagcgcgcagacgatcggcgcgctgtcgggggtggccgggacgaacgtcaacatgggcggcaacgggctgacgctgggcgggacggccagcggcaccttcagcggcgtgatcggcggcacgggcagcctgacgctggccggcaccggcacgcagacgctgacgggcgcgaacgcctatacgggcggcacgaacctgaacagcggcggcctcgtgctcggcaacggcggggcgctcggttccggcgcgctgaacgttggcggcgcggcgacgctcgacacgaccacgagcctgtcggtcaacaacgcggtcaatcttggcaatggttcgacgctgacgctcggcggcagcaacgcgctcacgctgaacggcggcatcgccggcgcgggcggtctcgtgaaggacggtgcggcgacgacgacgttgacggccgcgaacacctacacgggcggcacgacgatcaacgccggcacgctggcgctcggtgccggcggcagcctcgcggcgacgggcgcggtgaacgtggccggcgtggggcgacgttcgacgtgagcggcgcgacgggcgcgcagacgatcggcgcactgagcggcgtggccggctcggccgtgaacctcggcgcgaacggcctgacgctgagcgggaccgccagcggcaatttcggcggcacgatcggcggcaccggcggcctgaccgtggccggcacgggcacgcaaacgctgtccggcacgaacacctacacgggcggcacgacgatcaacggcggcagcacgctggcgctcggcgcgaacggcagcctggcgtcgaccggtacggtggacctcgccggtgcgggcgcgacgttcaacctgagcggcgcgtcgggtgcgcaaacgatcggtgcattgaacggcgcggcgaatacgaacgtggatcttggcgcgaacgggctgacgctgagcgggacggccagcggcacgttcggcggcgtgatcggcggcacgggcggcgtgacgtacgcgggtaccggcacgcaaacgctgacgggtgcgaatacctacacgggcggcacgacgatcaacggcggcagcacgctcgcgctgggtgcgaacggtagcctggcgtcgagcggtgctgtgaacctggccggcgcaggcgcgacgttcgacgtgagcggcgcgtcgggtgcgcaaacgatcggcgcgttgaacggcgcggcgaatacgaacgtcgatcttggcgcgaacgggctgacgctgagcgggacggccagcggcaccttcggcggcgtgatcggcggcacgggcagcgtgacgtacgcgggcaccggcacgcaaacgctgaccggcgcgaacacctacaccggtggcacgacgatcgacgccggcagcacactcgcgctgggtgcgaacggcagcctggcctcgggcggtgccgtgaacctggccggcgcaggcgcgacgttcaacctgagcggcgcgtcgggtgcgcaaacgatcggtgcattgaacggcgcggcgaatacgaacgtggatcttggcgcgaacgggctgacgctgagcgggacggccagtggcaccttcggcggcgtgatcggcggcacgggcggcgtgacgtacgcgggcaccggcacgcaaacgctgaccggcgcgaacacctacaccggcggcacgacgatcaacggcggcagcacgcttgcgctcggcgcgaacggcagcctggcgtcgggcggtgccgtgaaccttgccggcgcaggcgcgacgttcaacctgagcggcgcatcgggctcgcaaacgatcggcgcgttgaacggcgcggcgaatacgaacgtcgatcttggcgcgaacgggctgacgctgagcgggacggccagtggcaccttcggcggcgtgatcggcggcacgggcggcgtgacgtacgcaggtaccggcacgcaaacgctgaccggcgcgaacacctacacgggcggcacgacgatcaacggcggcagcacgctggcgctcggcgcgaacggcagcctggcgtcgggcggtgccgtgaaccttgccggcgcaggcgcgacgttcaacctgagcggcgcatcgggctcgcaaacgatcggtgcattgaacggcgcggcgaatacgaacgtggatcttggcgcgaatgggctgacgctgagcggcacggccagcggcacgttcggcggcgtgatcggcggcacgggcagcgtgacgtacgcgggtacgggcacgcaaacgctgaccggcgcgaatacgtacacgggcggcacgacgatcaacggcggcagcacgctggcactcggcgcgaacggcagcctcgcgtcgggcagcgcggtgaacctcgccggcacgggcgcgacgctcaacctcggcggcgcatcgggcgcgcagacgctcggcgtgctgaccggcggtaccggcacgaacgtgaacctcggcgcgaatacgctgacgctgaacggcagcggcaacaacacgttcggcggcgcgatcggcggcacgggcagcgtgacgtacgcgggtgccggcacgcaaacgctgaccggcgcgaatacgtacacgggcggcacgacgatcaatggcggcagcacactcgcgctcggcgcgaacggcagcctggcttcgggcagtgcggtgaatctcgccggcacgggtgcgacgttcgacgtgagcggcgcatcgggcgcacagacgtttggtgcgctgagcggcgcgaccggcacgaacgtgaacctcggcggcaacgcactgacgttgaacggaagcggcgggacattcggcggggcgatcggcggcacgggcagcgtgacgttcgcgggtgccggcacgcaaacgctgacgggtgcgaacacctacaccggcggcacgacgatcaacggtggcagcacgctggcgctgggtgcgggcggcagcctcgcgtcgggcagcgcggtgaacctcgccggcacgggcgcgacgctcaacctcggcggcgcgacgggcgcgcagacgctcggcgtgctgaccggcggtaccggcacgaacgtgaacctcggtgcgaatgcgctgacgctgaacggcagcggcaacaacacgttcggcgggacgatcggcggcacgggcaacgtgacgttcgcgggcgccggcacacagacgctgaccggcgtgaacacgtacacgggcggcacgacgatcaacggcggcagcacgctggcgctgggtgcgggcggcagcctggcgtcggcgggcgcggtgaatctcgcgggcacgggtgcgacgtttgacgtaagcgccgcgacgggcgcacagacgatcggcgcgctgagcggcgcgggcggcacgaacgtgaacctcggcacgaatgcgctgacgctgaacggcagcggcaacaacacgttcggcggcacgatcggcggcacgggcggcgtgacggttgccggtagcggcacgcagacgctgacgggcgcgaacacctacacgggcggcacgacgatcaacggcggcagcacgctggcgctgggtgcgggcggcagcctggcttcgggcagtgcggtgaatctcgcgggcacgggggcgacgttcgacgtaagcgccgcgacgggcgcgcagacgatcggcacgttgaacggtgcgaccggcgcgacgatcaatctcggcgccaatgcgctgacgttgaacggcagcggcaacggcacgttcggcgggacgatcggcggtgcgggcggcgtgacgatcgccggcaccggtgtgcagacgctgacgggcgcgaacacgtacacgggcggcaccacgatcgcggccggcggcacgctgcaactcggcaacggcggcacgtcgggcagcatcgccggcaatgtcgtcgacaacggcgcgctgatcgtcaatcaatccggcaacgtcacgattgcgagcgtgctgtccggtgcgggctcgctgacgcaggccggcagcgggcaactgacgttgacgggcaccagcaccttgagcgggccgaccacggtcagcgcgggcacgctcgccgtcaacgggtcgctcggccagtcgaccgtcaccgtgcagaacggcgcgacggtcacgggcaccggcacgatcggcggcctcgtggtgcagggcggcgcgacggcggtcgcgtcgcagccgggcgcggcgctgaacgtgggcggcaacgtcacgttccagccgggctcgacgttccaggtcgcggcttcgccgcagcaaagcggcagcctcgcggcgggcggcacggcgacgctgaacggcggcaccgtgcaggtgctcgcgaaccagagcggctaccagccgagcacgacctacacgatcgtgaccgcggcatcgggcgtgcagggcgcgttcagccaggtgaatgcgaactatgcgttcctgatgccgacgctcagctacgacccgaatcacgtgtacctgcgactggtccagaacggcacgtcgctgcccgacgtcgcgacgacgcccaaccagcgcgcggtcgcggccgcgctcggcgggctcggcgccggcaatccgctgtacgacgcagtcctgacgaccgacgtgccgaccgcgcgccgcgcatacgggctgctcgacggcgaactgcaggcgagcctgaagagcatgctgctgctcgacagccgctacgtgcgcgacgcggtgaccgatcgcgtccgccagggcctcgcgcccggatcgggcccgctcgccgcgctgtcgtcgggcggcgccgcgctatgcggcgacaacacggccggcgcggtcgacgcgacgctgccgccggaacgacggatcggctcgcgcgagggctgctacggcggcacgccttatcaaccggtggtctgggggcaggcgttcggcggccgcagccggctcaccggcgacggcaacgcgtcgacgatcaatcgcagcatgacgggcttcatcgccggtgccgacatggcgctcaacgacaagtggcgtgcgggtctggccgcgggcgtcacgcacagctcgctcgacaacgcccagagttcgtcggcgtcggtgaacagctactacctgtcgctgtacggcggcgcgcagtacggtgcgctcggcgtgcgcggcggcgcgtcgtacacgtggtaccggatcaacagcgaccgcaatccgggcttcgcgggcttctccgatcacgattcggccggttacgacgcgaattcggcgcaggtgttcggcgaagtcggctacgcgctgccggtcgggcccgtggcgatcgaaccgttcgcgggcctcgcgtatgtgaacctgcataccgacggttatacggaaacgggggcgcggccgcactgcgcgccggcggcgagacgacccacgtcggcttctcgacgctcggcttgcgcgcggcgtcgcagctcggctcgatcgggagcggcacgttcaccgcgcgcgggacggtcggctggcggcatgcgttcggcaacgtgcggccgtcgtcggcgttcacgttcgcgaacggcggcacgtcgttccaggtgtcgggcgtgccgattgcccgcgacagcgccgtgctcgaggccggcatcgacgcgaacatcacgaagcgcctgacgctcggcctcacgtacagcggccagtacggcagcggcgtgcgcgacaacgccatcctcggcaacatactgtggaaattctgatccgcaattgaagtgcctgtaagcgacgccaggcggcgacggcaacgtcgcatggcgtcgcgctctttgcgtcgctgcgcacgttccccgttctgtcctatcctgtgcgaaccacgcggcgcgccacgcgcgtcgcgctcgacacaggagcatcgatgccgaatcacgccgaagccacgacgacccaggcgccgcaggttgcgccaactgccccgaccccgcgtcgggccccgcattcatcgcacccgaagccgatccgcaggcgctggcgcgcaacaaccagtacgtgctgaaatccggcaacgcgttcgtggtcagcgacgcgctcggcgacatcggcggtcatgacgacggcctgttcgtcgacgacatgcgcgtgctgtcgaagtggcgcttgacgttcggcggccgcgcgccgtcgctgctgtcgggcgcgacgagcgccgacaacgcgtcgttcaccgcccacctgacgaaccgcccgctgccgccgctcggcggccacgaaacgcccgagggcgtgatccacatcgagcggatacgcgtgctcgcgggcgacgtgctttacgaagcgctgacgctgacgaactacggctcgagcgaggccgaggtgccgctgtcgctgtcgttcgcggccgatttcaaggacatgttcgaggtgcgcggcacgcagcgcccgaagcgcggcaccgtggtggcgccgcgcgtcgacgcgggcgcggtgcggctgcgctacgacggcctcgacagcgtcgagcgcaacgtgaccgtgcatttctcgccggcgcccgacgcgctgtcggtcgatcgtgccgactacacgctgacgatcgccgcgcaggcatgcgtgtcgatctacctgaccgtcgatgcgacgctcggcccggcgcacgaggaagggccgggatgcggccgcgtcgcgctgcgcaccgcgctcgtcggcgtgcaccgcgaaatgcgcgcgcggcgcgaatcgatggcgcgcgtgaacaccggcaatccgctgttcgacgcgtggctcgaccgttcgctcgcggatctcgggctgctcacgacgcagctcgacacggggccgtacccgtatgcgggcattccgtggttctcgacgccgttcggccgcgacgcggtcatcacgtcgttgcagatgctctggctgcaaccgtcgctcgcgcgcggcgtgctgcggttcctggccgagcaccaggcgcgcgagacttccgcgttccgcgatgcggagcccggcaagatcatgcacgagttccgccgcagcgagatggccgcgacgggcgaggtgccgttcgcgctgtactacggcggtgtcgatacgacgccgctgttcatcgtgctcgcgggcgcgtatgtcgaacgcaccggcgacgatgcgctgatcgacgaactgtggcccgcgctcgagcgtgccgcgcaatgggtgatcgacaagtgcgaccgcaatccttacgggctgctcgattaccagcgcacgtcggagcgcggcctcgcgaaccagggctggaaggacagccacgattcggtgttccatgcggacggccgctttccggacgggccgatcgcgctcgtcgaagtgcaggcgtatgcatgcgcggcgctcgatgcgatgtcgatgtgctcgtaccggcgcggccacgcggccgacgccacgcgttatgcgttgcgcgcgaaggcgctgcgcgagcaggtcgacgcgctgttctggatgccggaaggcgatttctacggcatcgcgctcgacggtcatggcgacctgtgccgcgtgttcgcatcgaacgcgggccacctgctcgcgttcgggctgccggacgccgagcgcggcgcggcggttgccggcgtgctcggctcggcgctgttccagaccggctggggcatccgcacgctggccgccggccagccgcgcttcaacccgatggcgtatcacaacggctcggtgtggccgcacgacaatgcgctgatcgcgcgcggcctcgcgcgctacggcgacaagacggccgcggtgaacctgctgcgcgcgctgttcgaggcggcggtgagtttcgagatgcgcctgcccgagctgttctgcgggtttccgcgccggcgcggcgaaccgccgaccgcgtatccggtggcctgcctgccgcaagcgtgggcggcgggcgcgccgttcatgatgttgcaggcctgcctcggcgtgagcatcgacgcgtcgcgtcacgaggtgcgcgtcgagcgcccgatgctgccggaaggcgtcgactggctgcggatcgacgcgttgcgcgtcggtgacgaaaccgtgtcgctcacgttccgccgcgtcgacggccaggtcgtcgcatcggcggagcagccgggccgcgtgaaggtggtcgcggtgctgtagcgcggtgccgcgcgaacgttgcgcgatgtcgcgccacgttcgcgcgacgcggcatagaatcgtgacatgacccttgaacaatggcggaggtagacgatgacgaccgacaaccggcccgacgacggcgagcacaagctcgagaatctggaagcggcggtcgaccacctgcacaagtcgatcgaatcgcagagcatcgcggtcggcgcggcgaaaggcattctgttcagcctgatcgaaacgctcggcgcgctgattggcgatcccgacctgcccgagcatgcgcgctcgggttacgaggcgctgcgcgacaaggcgagcgaactgcgcggcgggcttgaccggcattgatgcgcggatggcgccggcgttggccgaaagggctgcgccggcgctgcccgattctgcagacgaagcacaaaaccccgtgcgctcaatgagttaggtggccgatgcgcaggatatccacaagcttgccaacacaatctgtggagaaccgtccggccccgggccggaggtgcggcgcgtgccgtgcgaaagcgcgtgcggtgccacacggttgaccgcgcaaggtccttgtatcgaatcccctttgtatcagcgtgttacgcgtcgcatcggcaggatatccacaggcttgccaacatattctgtggataactcgcaatcgattgcgtcgcgacagttgacgatcgggcctccgagggcccgctcgcgaagcccgtgcacacgggctgcccgatgtctgcgtccgcacgctaattcgtgcgcgatcaacggcttaggccccgggtacccaggatatccacatccttgccaacactttctgtggacaagcggggccgtgtcattcggcctgcgccgcggcggctgcctcggccacgatccagtcgcgaaagagcgtcattgccggcgtgagcggcttcgacttcagcgaggtgagccagtagccgccggcgcgcacgtcgacgtcgaacggccgtgcgagcaggccgagctgcagttcgcgtacgaacatgcatgccggcgcgagcgcgacgcccgcgccctgcatcgcggcctcgaccatcagccgcgacgaatcgaacacgggcccgttgaccgcccatggcgcgagctgcgcggcgtcgaaccagccgagccattcgtcggtgcggtacgagcgcagcagcgtttcgttcgcgagatcggccggttgcgcgaggcgtcgcgcgatgtccggcgcgcacagcgcggtgagcggcgcgtcgagcaggtgctcgttgcgcgtcgccggccagctgcctgccccgaagcggatcgcgaagtcgaggccctcggcggcgagatcgacgacgttgttgttggtccgcagccgcagctcgacgaacgggtgcgtatcgccgaactgcttcaaccgtggcattagccagcctatggcaaaggtgccgacgacgccgagcgacagcacctcgtggaagcgcccgccgtcgaactgcttgagcaccgtctcgatgcggctgaacgcgtcgctcagcacgggcagcagcgcacgccctcgtcggtgagcccgaggccgcgcggcagccgcgtgaatagcgtgcagccgagccgctcctcgagcgaacgcacctgctggctgaccgcggcctgggtcacgctcagttcgaggccggcgcgcgtgaagttcaggtggcgcgccgacgattcgaacgcgcgcagggcattgagcggaagatgagggcggagcttggtcataagattttctttgtcagcgctcaattatcgttgcttgtcaggcaaccgtaaagtcacgatagtgctgtctcggcggccggccgttttcactatcgattcgcctccattccatcacgagaccaccgacatgacctactcatcgaaacgtcgaaccctgttgctggccgccgcgacggcgctcgttctcaccgccaccgcgtgcgcgtcgcggcaggccgccgcgcccgacgaggcaagcgccgcggccgcggccgtggcgcctgccgccgccgggcagatgctggccgagctcgaaagcagcgtgggcggccgcctcggcgtgtgcgcgatcgacacggcgagcggccgggtcatcgagcatcgcgcggacgaacgtttcccgttctgcagcacgttcaaggcgatgctgagtgcggcggtgcttgcgcagagcgtcgggcgttcggcgttgctgcaacagcgcgtgacgtatacccgcgccgatctcgtcaactattcgccggtgtcggagaagcatgtcggcgagggcatgacggtcgccgcgctgtgcgaggccgcgatccagtacagcgacaactcggccgcgaacctgctgatgaagctgctcggcggcccgtcggcggtgacggcctacgcgcactcgatcggcgacgacacgttcaggctcgatcgatgggagaccgaactgaataccgcgctgccgggcgacctgcgcgacacgacgacgccggccgcgatggccgcgagcatgcgcgtgctgatggtcggcgatgcgctgccggccgcgcagcgtgcgcagctcgttgcgtggatgcgtggcaacaaggtgggcgacaagcggctccgcgcgggcgtgccggccgggtggacggtcggtgacaagacgggcaccggcgactacgggacgaccaacgacgcgggtgtcgtatggccgccgtcgcgtgcgccgatcgcggtggccgtgtactacacgcaggcgcgtgccgatgcgcgctcgaaggacgacgtgatcgcgtcggtcgcgcgcatcgtggttcaggcattcggttgacgcgggcggtgcggtgcgcgtgacgcgatgcgcaggcgggccgtgccgcagtcgtgacccgcgcgatcaaacgttgtgcgatcaacgacttaggtcacgcatgctcaggatatccacatgcttgccaacaaaattgtggacaagcccgcgcgcagcgtggcgcgggccaccgtgccgcatttgaggcggcgcggacaaagcctttcggatcaagcgcttggtcgcggtatgcgcaggctatccacacgcttgccaacacaatctgtggacaagccggttcgcctgcgcggaaggcggcccgtcacgtggcgcgacgacgtgcgagcggcactttgccggccgcgtgccgcatttgaggcggcgcggacaaagtctttcggatcaagcgcttggtcgtggtatgcgcaggctatccacatgcttgccaacacaatctgtggacaagcccggcagccgctttggcgacggtcagggctgccgatcgtcgaccgtgggccagcgcacgaacgcgaacacccacaacatgacgaagttcaggatcgggacgaacatcgtcaggatccaccagcccgaatgcccggtgcgccggacgatgcggacgtacggataaacgacgacggcgacgagcacgagtgagacgaccagctgccacgcggtgaagtgttccatggccttcctcggagtgaagtgtcgggcggaacggccggcccgtcgaaccgtcgcgcgaagccggcgatgcacggccgcgtgcggctcgcgtgatcttgacgcgtggcgggcgcgagcgtcaaggcgagggcggtgcacggcggcgacgcgtcggtcgcgcggggcgtgcgcattcacgcatgtccgggccacacgctgccgcaaccgtgacgcggcgcatgaaccgtaagccgatcaacgggttagcgcacgcgtgcgcaggatatccacaagcttgccaacaaaatctgtgggtaagtggcgcggcgcatggccggcacgtgtgcgccggccgcgacgtgcatcgtcgtggcgtcgtgatgcgaagtgcggcgaagcggtggacgcggcggccgtcaccggggccgcgtctgcatcacgcgtgccaaagtccatcggatcaagggtttagcgttgcggtgcgcaggatatccacaagcttgccaacattttctgtggagaagtccggctgcgcgcgacgcgcggacacccgcgaatgccacgcgttgccgcgatgcgtgcgggcgctcacgcagtgcagatgccggccgcgccgactttctggaacaggtgcgggctcgcgacggcggacgacggacaggccgacagcctgacgacgaacccgggatgcgtgaaggccgcgcgaaacgctgcggtcgattcccggatcgcacagtacggccggctccattacacgggcgaacacgtcggcgcctcatccatctagcggtaccgtcgtcgtgcacgaagagggccgaacccgacccaagccggacggctgtcagaaaggccttctatattgctacgggtcgaagcacgcaagcatcctcgaaacctcgaccggcctgcgagtcgaacggatcgtcgtcgggaattgagacgaaggaggggcggcgcatgacgcgcggtcgaggctacggtggcggcgtggatgtgcctgttcacgaccgcatggcgcatttgccgcgcagctccgacaaaccctttccgatcaatggcttggtgtcgttaatggaaggttgtccacacgcttgccaacacaatctgtggaaaagccgcacgtcgcacgtggcacgtcgcgcggcgtcaggccggtagcggaaagcgcaccgtgacggtcagcccgcgcccgccgcgtgtcgtgccgagtgcgaccgtcgcgcgatgctgttcggcgatccgcttgacgatcgacagcccgagcccgctgcccgacgacgtgactgcctgcgcgccctcgccgcgatagaaacgctcccacacgtcggtgcgttcggcttccgggataccggggccgtcgtcggcgacttcgagcacgggcgtcgtgccgtcgagccgcgcggacacgtcgacacgcgcgccgtcgcccgcatagcggatcgcgttgtcgacgaggttgttcagcagcacgcgcagcgtgtcggcattgcccgacgtcatcacgggcgtcgacacgatcgcgccgagatcgatccggtgcgcgtcggcgacgcgcgtgcggtccgataccaccgaccggcacagcgcggcgagatcgacgggtgccgacgcggaggcggccgcctgcgcatcgggttcgaggcgcgcgagcgtcagcagctgttcggcgaggtggccgagccgcgtcgtgccggcatggatctgcgcgaggatgtgctcgcgttcctcggcggtcgacgcgcgccgcagcagctgcgactggatcgacaaccccatgatcggcgtgcgcaattcgtgcgcggcatcggcgatgaagtgccgttgcagcgtgaacgaacggtccaggcgcgcgagcaggtcgttgatcgcttcggcgagcggacggacttcgttcggcatcgcgccgacgtcgaccggctcgagattgttcgcattcctgcgtttgaggccggatgcgatcgtgcgcagcggccgcaaccccgcgccgatgccgaaccacaggccgatcgcgagcagcggcagcatcgagaacacgggccacagcaggtgcacggcgatgcccgcgatcgcttcccagcgcgcatggcgtgcctgcgcgagccggatcgtcgtgccgccgcgttcggtcacgtaggtgcgccacggctggccgccgacgtcgacgctcgcgatgcccttctgctcgggcggcggcagggtcgaatcgcggtcggtcgaatacacgagcttgccgttgcgccagacctgtagcagcacggcgtcgggatcgctcgcctcgaaaccgtgcttgccgttggcgcggttgctgaacgacagctcgccgttcgggccgacgacgatctgcttcgacatgctgcgcatctggtcgtcgagcaggtcgtcgagctcgcgcagcgcgccccagtaggtgccggcactcgcgacgaggccgatcacgcacgcggccgggagcagccacatcagcaggcgccgccgcagcgacgcgttgcgccagcgcgcgatcgcgtgttgcatgcgcgtcatgcgccgtcaccgatccggtagccgacgccgcgcaccgtgcggatcatgtcgtggccgagcttcttgcgcaggttgtggatgtgcacctgcacggcgttgctctcgatttcctcgccccagctgtacagccgctcctcgaactgctcgcgcgaaatcaccgcgcccgggtcgcgcatcagctcgtgcagcagcacgaactccttcggcgacagtgtgacttcgtcgtcgccgagccagacgaggtgcttgacggggtcgagccgcagcgggccgatcgcgagggtcgtctgcgcgcggcccgcgtggcggcggttgaccgcgcggatgcgggcgagcagttcgtcgagttcgaacggcttgacgagataatcgtccgcgccgctgtcgaggcccgcgatgcggtcgggcacgccgtcgcgcgcggtgatgatgatcgcgggcaggttttcgtcgcggcggcgcagcgcggcgagcaccgacaggccgtcgcggttcggcagcccgagatcgagcagcagcaggccgtagccggtcgcgcgcaacgcgagcgacgcggcgtcgccgtccttcacccagtcgaccgcgaagccttcctgtttgaggccctgttcgagcccgctgccgatcagcggatcgtcctcgacgagcagtacgcgcatggattcgtgtctcttcaacggggcgccatggcgcccggggttccatgataagcgcgcgtgccttagcgggagcttaaacacgggcgcgcggccggcttgcgcgcgtgcccggtgcggcaccgtgccgctgcggcgcgaccttcaggtttgcttaatcttacggtccgtaatctggggccgtcgcgttcaacggagcgcggcgtcacatcgaagaagaggaccgagatcatgaaacacctgacgagaatcctggcggttgcgctcgccgtgctgcccgccgccgtttatgcggaatataccgggccgtccacgctgaccacgacgaccgtgaaggaactgctcgcgaacggcaaggacgatcagcacgtgcagttgcaggggcgcatcgtcaagcatgtcggcggcgaggattacgaattcgccgatgcgacgggcacgatccgcgtcgagatcgaccacaagctgtgggcggccggccagcccgtcagcgaccggaacgaagtgaaggtgaccggcgaattcgagcgcaaatggtcgggcagcgtgaaggtcgacgccgaccacgtcgaagtgctgcgctgaccggcgcaccggtgatctggggccggtgataccatggacgaccggttcccgttcacaccaagatggccgccaatttcgacgaactcgcgtcccggatccgggcgcaattttccgagctgagcccgcaattccaggcgggcgcggccttcctgctcgatcatcccgacgaagtcgccacgtcgtcgatgcgcaaggtcgcacagcgcgcaggtgcagcccgcgtcgctcgtgcggctcgcgcagcaattcggcttcccggctggaacgaactgcgcgacctgtgtgtcgcgcgcgtgcgcacgcgccccgagccgctcacgcagcgggcgcgctcgctcgtgcggcccgatgcgaaggcgtcgctcgcgcacgacctgctcgccgcgcaacaacacaacctgtcggccaccgccgcgcagaacgagcacgcgctcgccgatgccgcgaaactcatccgcaaggcgtcgcacgtgcatgtcgcggggtttcgctcgtgctacccggttgcattcggcttcgtgtacggctaccggctgttccgcccgaccgtgtcgctgctcaacggcgtcgccgggtcgctcgaaatggagctgcggacgatcgcgaagcagagcgtgaccgtcgtcgtcagcttcgcgccgtattcggcggaagcgacgcgcgtcgcgcaggccgcgaaggcgcagggcagccggatcgtcgcgatcaccgacagcgcggtgtcgccgatcgcactgcacgcggacgcacaactgatcttcacgcacgacagcccgtcgttcttcccgtcgctggtggccgcgcacgcgatggccgaagcgctggtcgcacagttgctggcgctcgaaggcagcgatgcgatcgccgcgctcgagcgcacggaagcggagctgcatgcgaagggcgcttacgtcgtctgacgcggtgcgtgcgggttcaaccttcttcatttccgattcaaccggactcgaccgatgacgttcacatacgaggtgaccgacgcggggacgtgaacgttcgcaagcagatcgtcgcgccgctcgtccgattcaacgaaagccaggcgggcccgaacgacttccgtgcgctggccgtggtcgtgaccgacgtcgaaggcacggtggtcggcggcttgtggggcagcacggcgtacggctggctgcatgtcgacctgctcgtggtgcccgaggccgcgcgcggccagggtgcaggcacgcgcatcatggatctggccgaggcggaagccgtcgcgcgcggatgccacggcgtgtggctcgacacgttcgacttccaggcgcggccgttctacgagaaacgcggctatgtccgcttcggcgaactgccggattatccggccgggcacacgcgcattttcctgacgaagcggcttgcgggctgagcatcgccgcatggagcggcccggttgacgcggtcgccggccgtcgcctaggatagcggccagcgatgcaggtcgcttccgggtccgcggaaagggttgaacccacctgtcgcagcaaatccagtcttcctcctgtcctttgtgctggcggtattgcggaccttcggccatgactgcacgaggattcgcatgaaaaagctgcctcccgggccaatcccgatcatctgaaaaagcaggccaaggcattgttgcgcctgtaccggcagggcgacgccgacgccgtcgcgcgctttgtccgctttctccctgccgctgccaaccgcacgcacgacgaagcgctcgcgctcgggctccggctgcacgatgcgcagtcgtgcattgcgcgcgagtacggtttcgcgtcatgggccgatctcggcgcgttcgtcgaaacgcatgcgctcgccgggcaacagcggtcggcgttgatccggcgctggctcgacctggcgtacggcgccgacgtgacgggcggtttcgatgcggcccggccacgtgtcgccgcgcaactgctgctcgaccggcccgatctcgttgcaagcgatccgaccgtcgcgtgcgcggccggcgacctcgatgccgtgaaggcggcgctggccgccgatcccggatggatcgcgcgcgccggcggcgtgctgaagctgccgccgctggttgccgtcacgcattcgcggctcgggcagattcccgggttcgccgtccggctgcgcgcctgcgcgcgtcatctgctcgatgccggcgccggtccgaaccagcggatcggtaaccggtttccgccggcgtcgcttgccgcgcccgacgaagcggggccgctgtcggcgctgtacggtgccgcgggcgtcaatcgcgatccggttctgaccgcgatgctgctggaagccggcgccgacccgaacgacggcgaatcgctctatcactcggtggaaaatccggcctgtacgcgcctgctgctcgaacacggcgcgcgggtgggcgggaccaatgcgttgcgtcgcgcattcgacatgcgcgatgcggacgcgctcgaactgctgctcgcgcatggcggcgacccgaacgagccgcccggcgaggggctggcgcagacctggggcgcaccgttgttgcgggcgatcggcgtgcgctgctcggcgcgccacgtcgccgcgctgctggcggccggcgccgatccccgcgcgcggaccccggcgggcgtcagtgcgtaccggctggcgatgcagaccgggctgtccgaggtcgccgcgttgttgcgtgcggcgggcgcggaagaggcgctcgacgccgaggacgcattcgtggcggcctgcgcgcgcgccgacgccgacgatgcgcgacgcatccaggcacggcatcccgaactgccgggcgcgctgcccggcgagcggctgcggctgctgccggatgccgccgcgtggggatcgggcgacgcggtgaaggtcatggtcgaactgggctggccgatcgcggcgcggggcggcgactgggacgcgagcgcgctgaatcacgcggtgtttcgcggcgatgcgggcttgctggcgttcctcctcgagcacggcgcgagctggcgtgacatgcacgggttcggcagcgacgcgctcggcacattgtcctgggcatccgtcaacgaaccggagcatgtcggagcagccgactgggaggcttgcgcgcgggtgctgctcgcgcacggtgtgccgcaagccgcgcgggacccgtcgaatccggacggcgtactgatcgacggtcgcgcgatgcgtttctccgaagccgtcaccgacgtgttgctcggcatcgacggcgggccaccggcggcacggtaagcggctatcggttggcaacggatgggcggcggcggcccgctcgttgtcggttgccgattgcgggttgccggctcccggctcccgactcccgactcccgactcacgactcccagcttccggcttccggcttccggcgtgcagtcggcgcatcggtttttcctgtcgcgcgacgacatttcggtgaacgctgaaacgtcgcgtgcacgatcggcgtaagctcggccgtcaactttctcctggagcccgcgatgacccgttccgatcttcaagcccgccaagccgaagccttccgcgccctgcatgcacgcgccggcgccttcatcatcccgaacccgtgggacgccggtaccgcgcgcctgctcgcgatggccggcttcgaggcgctcgcgaccacgagcgccggctacgcctttcgaaaggccggcccgactatgcgatcgaccgcgacgagatgctcgatcacatcgccgagatcgccgccgcgggcggcctgcccgtgagcgccgacctcgagaacggcttcggcgatgcgcccgccacggtggccgagacgatccggctcgcggccgaggccggcgcggtcggcgggtcgatcgaggatgcgacgggccgcgccgacgcgccgatctatgcgcacgaagcggcggtcgagcgcatcgcggcggccgtcgacgcggcgcgtgcgctgccgtttccgttcacgctgaccgcgcgctgcgaaaactacctgcacggccgccacgacctcgccgacacgatcgcgcggctcgtcgcctatcgcgacgcgggcgccgacgtgctgtatgcgccgggcatcaccgatgcggacgacatcgcggcggtgacgcgggcggtcggcgcacccgtgaacgtcgtgatggggctgcagggcggattgctgagcgtcgacgcactggcggcgctcggcgtgaagcgcgtgagtgtcggcggcgcactggcgcgggccgcgctcggcgcgttcctgcgcgccgcgaaggagatggcgcaggacggcacgtttacgttcacgcaagcggccgttcccgggcgcgatatcaaccgctggtttgcgtcgccggataattcaccggttttgttcggtgaatgagtgtaaataaatcgtgggatcgttcccaatcgaaaagttgattgataataatcaatcgatttcacgtcagaattaaacgtcggtgacgacgaaaaatacatcgtctattctccgcatttcgcccgttcgaccgggtccggcgcgcaagccgcgccggatcgggcggccgggcatccgccgggcgtgtcgatggcgcgcattgttgcattttcccgatcatgacatttttgaaaagggagttgccggccggtttttgattgataatctgcggcacgttcgaatgaacagttggtgggctgccgggaatatcgatatataaaaatgctgagagagcgatgacgatccgagaaaatcaacgcgtcaggtttcgcgtcggcgatgtcgtgacgctgaagacgggcgggccgcgcatgaccgtgacctatgccgggccggtcgtattcgacgacggcgactggctgatctgccagtggttcgacgaacacggcgaattccggcaggaaatgttccctcacgacaccgtggtgccggagccgcgcgcgatttcggccgggcgtgtccgcatgcgcatgcagtcgcatcgctaccggtcggctgcctgacattcacctgacatcgcgaggcggccgcacgcggcgcccgcgccgcgacatttcacgccggcccgaaacatgcggcggtgcactgcgtcgatactgtctgcatgaacctgaccgatcccatcgcagcggttacgcaccgcgatccctatccctactatgcggcgctcgtcgacgggccgccgctcgcgttcgacgccacgctcggcctgtgggtcgcgagccgcgcggccgccgtgacggccgtgctcggccatccggcctgccgcgtacgcccgctggacgcgcccgtgccgcccgcgttgcgcggcacgacggccggcgcgctgttcggcgagctggtgcgcatgaacgacggcgcgttgcggcacgacgtgccgaagcaggcgctgcgcgcggcgttcgcgccgatcgacacggctgcgttgcgcgaccgtgccatgcagctcgccgcgcggcgcctgccgccgccgggcgatgccggcgcgctgaacacgtggtgcatgacggtgcccgtctgcgcggtcgcggatctgctgggcttcgacgaggcgcagctcgacgcgatcgcggcgcaggtggtcgacttcgtcgcggcgctgtcgccgctgtccgatgccgaggcgctggcccgcgcgagcgacgccgcgcgacagttgctcgaccggatgacggtgcgcgtcgcgcagacgcatgcgcacgacggcacgctcgtcgccgccgtgcagcaggcggcccgtgcggcgggctggcaggcaagcggcgcgctggtcgcgaacctcgtcgggctgttgtcgcagacgtgcgaggcgaccgccgcctggctcggcaatgcactggtggcgtggaacgggggcgcggaagcgggcttggaagcgggcttagaagcgggcttagaagcgggcttagaagcgggcgcgggcgccgcgtgcgtcgtgccggacgatgccgcgctcgacgcgttcgttgccgaagtcgggcgcttcgattcaccggtgcagaacacgcgccgcttcgtcgcatcgcgcacgacgatcgaaggcgtgaccatcgaagccggcgacgcgatcctcgtcgtgctcgccgcggcgaatcgcgacccggccgtgcatcgcgatccgcaccggctgatgcccggccgcgcggccgggccgaatttcggcttcggcacggggccgcacggctgcccgggcgagcggatcgcacgggcggtgacagcgggggcgttcggggcgtggctgcgtgcgggcggcgggccgcggcacgacgggctggcgtggcattaccgcgcgtcgaccaacgtcaggatgccgaagttcgacgcggcagggtgatcgggaaagagggacttaacggcagccttgcttttccgcccattgctcctgggcggcgacacggcgctgcacgcgttcgacgagaccggttgaaaaggtccgcatgctgatgccgcgacgcttggcgaggatcgtctgcgcgacatcggtgcgggggttcggctggcaggcccagtacagcgtcatcagccagccgatgccggtccacccgaacagcgcgttgaacatcgcgaccgtcagcttgtcgtgccggccacgccggtcggcaatgaccgccggcagaaaatagatcgcgatcgcggccaccgaaccggccacttgaatcaggactgcgttctgcatgttgctgctccatccgaactgcaatggagccgattgtcgcgctttttccgttcgcgtgcaggccgcgctcagacaattgattgttgcggttttaatgatgatcagccggcttcggtgtccgccggctgcatttcgttgctcagcgcgaaaccttcgtcgcgccagcccgtcacgccgccgatcatcagcttgaccggccggccgaggtgcgcgagccggatcgccgcgcgcgcggcgccgttgcagtgcgggcccgcgcagtagacgacgaacagcgtgccggccggatagccggcgagcttgctctcgatgatcttgcggtgcggcaggttgcgcgcgccgggcacgtggccggcggcgaaccggtcggggccgcgcacgtcgagcagcacgaaatcgggcgcacccgatgcgagcgcgtcgtgcacgtcccagcaatcggtctcgaagcgcagcgacgcctcgaaatgcgcgagggcggcggggctgtcggcagcggggacgtcggtgacgtaggacatggtcgagttctcctgaaggttgcgcggaacgcagtggaatgaagggcagtatcgcggttcgtcgaccgtcgcggcagtggcgcgatcgacaagttccggtaacatcgcgccatgcataatcatctcgtcgtcgcgctcgcctacgatcgcctctgcaccttcgaattcggctgcgtggtcgaactgttcgcgctcgaacgccccgagctcggggtcgactggtatcgcttcgcggtctgcgcgagcgagccggggcccgtgcgcgcggcgggcggcatcacggtcgccgcgccgtatcggctcgcgatgctcgatcgcgccgataccatcgtgattcccggctggcgtgatccggacgaaccgccgccggagccgttgctgaagaagctgcgggccgcgcatcgccgtggcgcgcggctttgctcgatctgctcgggcgtgttcgtgctggccgcggccggcgtgctcgacggcctcacggtgacgacccactggcgctatgcggagaaactgcaggcgcgttatcccgcgctgcgcgtgaatcccgatgcgctttacgtcgacgaagggcaggttgtcacgtcggccggatcggcggcggggctcgacatgctgctgcatctcgtgcgccgcgatcacggcggtgcgatcgcgaaccgggtcgcgcagcgctcgtgctgccgccgcatcgcgacggcggccaggcgcagttcgtgccgcgcccggtcgcgccgggcggtaccgaccggctcgcgaagctgatcgactggatgcgcgcgcacgcggccgagccgcacacgctcgcgtcgctcgccgcgcaggccgcgatgagcacgcgcacgctgcagcggcagttcgcggacgcgacggggatgtcgccgctcgcatggctgatccgcgaacgcgtgaacgtggcgaaggacatgctcgaagcgcatcccgcgctgtcgctcgcgcaggtggcggcgcgtgcggggttcggttcagaggagtcgctgcggcggcatttccggcgtgtcgcggcgacgagcccggccgcgtaccggcgcgggatggatcgcggcgtaagatcgcaggacgcttgagcgccgcgctgttgcgcggtggctttcgtacccggcggcgcaccgcctgaccggggcattccggacgaaagcgcaacaaaccaacaacatgacactcagagagaacctcggattcggcttcatgcgcgacgacgcgcacgtctattgccacgatggcccgctgcgggaccgcgccggcaatctcatcgaaggcatcgcgatcgacagcttccggccgttgtcccggtatctggcgacggacggcgtgcgtgcctatgcgtgcactttcacgtggttgcgcttcaccgtgctcgacgtcgacgccgcgacgtttcgcctgctggacgagtcgcatgccgtcgacgcgaaccatgtctattttcagaaccggaaacttgccggcgcatcgcctgcgcgctttcggctgctgagcgaatcatgggggcatgacgaccgttacctgtatcactacggcaagcgcatgcgcggcgcggatcccgcgacgctacgttgggtcggcgcgtatctggtcgacgcacagcgcgtctggtacggcgggcgggcactggaaggcgccgatgcggcgagctttgtcagcgcggatgaagtggcgcaggatcaggcgaccgaccgcgcgcgtccctaccgttacggccatgcggatgatcccggcccgcgcgagcaatgggaacgcaactggtcgccgttcttcgccgcgcgccccgaattgcaggggtactggtggcacgcgctgatcgggcagcccgtggcggacgtatcgacgcgggaactcggcggcggataccgggtggtcggcgatcaggtgtacctgcacgacctgccgctgctcgaaccggatgcggggacggtccgatggctcggcgattcattcatcgcggaccgctcgcggctctattcgtattcggagtaccacaagggctttcttcgcggagggccgcttccgggcgatcctgcgcagtggcggcatcttggcgggccgtggtatcaggccggcgaccattgctatcggcagcaatggcgcggccatgcggaggccgcgaaggtcgacggcaagacgttcgagatcctgaacgatacctatgcgaaggatcgcaatggcgtgctgtgcatgctggtacgcaagcgcggcatcgatcccgcacgaatcgaagtcgtcggcgacgaccatctgcgggaggggaccggctgttctatttcggcaaggaagtgaaggccaggttcgacgccccgacggccgaaccggtcggtcacggctttctgcgcgacgggcaggggcgattgctgcactacaaccagccgtatcggcgcggcgtcgacggagcgacgctcacgttcctgtccgagtatttcgcacgggaccgcgcgcgggcctacgtctattgcaacggcgccgaactcgtgccgctgcccggcgtcgatccggccgcctttcatctggagcaacccgatatcggcacggacggcagtcgtcgctacgtgtatcaggcatggctggctgcgtggcgcgcgtgtgacaggtcgccgatgcccgactacgtgccgccggactacgtggcgcccgaagcgggagcacgggccgatgccggaccggcgcccgaatcggtgtcggcgaacgggttcctgcacgcgtcgcccgccgggccggacgccgcccggcgggcgtgcgtgatcgaatgggcgcgcgacgagacgggcgaaccgcgactcgtcgtggccggcgacggattctgcgacatctgggatctggcgcagcggcaagtggtcgcgtcgtttgcgctgcctcgtccgttcgtgcccgacgagacggaggcgacggcaatggaccgactgcgcaacgtgccggtgagcgcgtcggccgatgcgtcgttgtcgacgctgattgtcgcgtactgggacaacacggcactttaccgggtcgatgccgcgagcggtgcagcggacgcgtgctggcgggcagacagccgttatgacgatccggaacgggttcatctgtcgcccgacgcgcgcgaagcgtgggtgcgcatccgcaaccggctctatcgcgtgccgctcgccggcgacggcacgctcgacgtgctcgattacgatctggccgaccagcgtttccaggacgctccgttcgcggtgagcgccagccggcatcgccgcgcattcgcgcgggacgcggcgctgacggtgcgcacggatggcgcgaccgattgcgacatacccggtgcggacaacggctttccatgcgcgttttcggacgacggcacgcgcgtgctggcgcgcgacgcgaaattcgtgttgcgcgagttcgacgtcgacagcggcaagcgcctcgcgttgcatcgtggcggctggtgcgagcgcaagtggttcaagagccaggccggctggatcggcgggcgccccgtgttcgtcggcctgccgatgggcgggcagggcgaggtcgacatctgggatgtgctcgacaaccggctgctgtttcgcatcgaggccgccgcacgcgtgcccgagccggacgcgggctgacaccgtcgcgacgctgcgaccggtcgcgggaagaacgccgggcgattccgaagccgatgcgagcagccgacgcgatcgcgccgtgatacggcgcatgcatcctccaacccggcgacgacggtgcagcgcaggcggccggtgaccggagcaaccggccgcgtgtactgaacggccgcgtgccaccgcggccggtgcaggctcaccgcggaatggtgtcgcgcgccttctgcttgatgcacgcgatccggtacacgccatcctcgacttcgacaccgtgcgtgtcgtgcgtgaagcccgggaagcgcaggtcgtactgctcgagcgccttcaggtagccgagcagcgggccgtcggccggccctgcgttctcgccgggcatcagcagcggaatgccgggcggatagggcacgacgcccgtcgcgacggtgcggccttccatctccgacagctccagcatctcgatgtcgttgtgcacgagatgctcgaacgcctcggccgggctgtaatcgggcttcggcagcgtcgagaagccgcgcgacatcatctcggtcgtcttcaggtcgctcatcgcgctgaacatcaggtcgcacaggtcgcgcaggccgagcttgccgtagcgttccggatagcgcgcgacgagttcgggcagcacctgttcgagcggcgcgttcgcgtcgtagtcgcgcttgaagtcgagcagcgtgttgacgagcgtgccccacttgcccttcgtcacgccgagcgagaacaggaacaggatcgtgaagtcggtcgtcttctcgacgacgatcccgtgccggtcgagatacgcggtgacgaccgatgccggaatgccgaccggcatcagcccgccgtgcgatgcgacgcccggcgtgacgatcgacaccttgatcgggtcgagcatgcagtagtcgtcctcgatgtcgccgaagccgtgccacgtgtcgcccggatgcagtacccagcacgacgggtcggtggcgagcagcgtctcgtccgcttcgtggaagcgcacgcggcggcccgtcttgcgatcgacgacgttgtcgggctgccagccgttgaagaaccagtcgttgttctccgcgcattccgcatgcaggcgcgcaagcatctggcggaacgcgacggcctcgcggatcgcgtcggtcgtcagcgcctcgccgccggggccgtccatcatcgcggcgctcacgtcgttcgacgcgatgatcgcgtagttcggcgacgtcgacgcatgcatcatgtacgcctcgttgaagcgcgcatgctcgatcgggttgcggccgtcgcggacgtggatgaacgacgcctgcgacagcgcggcgagcagcttgtgcgtcgattgcgtcgcgaacaccgtcggcttgctcgcgtcgtgctgcgacggatcgccgtgcatcgcgtgacggtcgcggtagatcgggttgaagcgcgcgtagccgtaccacgcctcgtcgaagtgcaatcggtcgacgctctgcccgagcagttcctcgacacgtgcgacgttgtagcagaggccgtcgtacgtcgagttcgtgatcagcgcatgcacgggcgtcgggtcgatgccgtcgcggccgcgcacgagcgggttcgcgtcgatcgcgagccgcacggcggcggccgtcagccgttccggcatgatcggcccgatgatcccgtagtggttgcgcgacggaatcaggtaggtcggaatcgcgccggacatcgtcatcgcgtgctcggccgacttgtggcagttgcggtcgcacagcgcgacctggttgcgcgtgacgcttgccatcaggatcacgcggttcgacatcgacgagccgttcgtcacgtgatacgtgcggtgcgcgccgaacacgcgcgccgcgtagcgttcgctttcgccgatcgggccggagtggtcgagcagcgagccgagttcgccgaccgagatcgacaggtccgagcggaacagcgcctcgccgaagaattcgaagtacgcgcggccgaccggcgatttcaggaacgcggtgccgccggtgtgaccgggtgtgtgccacgagtattcgtacacgcgcgagaatttcgcgagcgcgcggaacatcggcggcagcacggtctcgcggtagcgttcgatcgcggcgacgatccgcccgccgatgaacgcggtggtgtcctccagcatccagatgaagtcgtcggccttgcgcatcgcgtcgacgggaatcgcggatgcgctggcacggctcgcgagcaggaacacgggcacggttgcgttacgcgcgcgcatcgcgtcgagcacggcctgcgcgggcgcgtggccggcgtcgttgccgagttcccagttgagcagcaggcactggatcgccggatcggcggcgacgaccgcgcaggcatcgtcggcagacgtcgcgatcacgacgtcgacgagccgggtgcgcagctcctcggcaagcgccgtcgcggcgcgcccggtggccgtgcgttcgtcgatgtcgtgctgcacgagcagcgccttcatgccgaggcggcggaaggccggttgggtcaaggatgcggtcatgtgtcattccccgtttgctgggttgcctgggcgctcgcggcaacggccggcgagcgcgcgtgaagggtgtcggcctggtgacggcccacggaaatccagaaggtcgcggcgagcgcggcgatggtcacgccgagcgcgagatagcgcacccagcgcggcgagcggccgcccggatgcacgtgggtttcctcgatctcgcgctggcggttgatcgacagctcgtagaagacgatcgtcgcgatgacgaagatcagcgaccagcgcgtctgctggccgtcggagccgaccatcgcccacagcgcgtagacggcgccgatcaggccgacgatcgtgtagaacgtgaactggtgcgacggcatcttgccgtagccgagcaccttgatcgcgatgcacgaatagatgtacggcagcagcgtcatgatcacggcgatcgacgcgatcttgccgaactgctcgctggcgctcggcgacatcgtcgcgagcacctgcaccgacatgatcagcgcgacgatcgcgaggccggccgacggcacgttcttcgagttgacgcgcgcgaacacgctggcgaacaggccgtcgtcggccgcggccttcgcggtctggccgaccagcagcgtccagcccgcgagcgagccgaggcagccgagcgccgcgcacagcgcgaccgcgttcgcggccgtattgccgagcgcgaggcgcgcggcatccgcgaacggcgcgctcgacgcgagcagcgccttgttcgggatcatccccatgatcacggtcgagctgagcacgtagcagacggccgcgagcaccacgccgccgacggtcgcgatcggcacgttgcgcgacgggttctcgacgacgccggccgacaccgatgcgctttccacgccgatgaacgcccacagcgtgaagttcagcgtcgcgccgatcgcgctgaagctgttggtgcccgacacgttccagccggcgaaatacacgtccttgctgaaccagaaccagccgaacacggccatcccgaggatcggcacgagcgcgaagaccgtcgtgaccgactgcacgcggccgacgacgttcggcccgaggatgttcgcgtacgtgaacagccagatcacgaagatctgcgcgagcgcgaacacgagcgggtccttcagtaccgggaagaaatgcgtgaggtagccgaggccggcgaccgcgaggccgacgttgccgagcacgttcgcgagccagtagatcaggttggtctggtagcccatgtacgggccgaacgacttgcgcgcatacgcgtacgggccgccggcggccgggtcgatcgcggcgagcttcgcgaacacgagcgcgagcgacacggcgccgacgacggtgatcagccagccgaagatcgcgatgccgccggtcgcggcgaggttcgcgggcagcatgaagacgccggagcccatcatgttgcccgcgaccatcagcgtggcgggaatgacgccgattttcggcgcggaagccgcgtccggcgtggcggcggcgcgggaggaggacgagctggcatcggacatgcgacgctccttgagaaggcgtgtttcggttgaggtgacgcggtgtggcgccggtcgacgattccggtgcggttcgtcgttttaattgacgcgttcatgttatcgctcggagcgattattaataagggtaaacgcttgtatttaataacttgaatattgatcaatgtcattgaagccggtgaaacggtgtttggcttcgggttcggcggcccgtgtggaaaggccggagcgcgtttttgccgattccggtccggacgggtgggatcgtgccgcggaagcttcgaagaataatcgcttttactaaccggttaaatcaattcgcaatgcaaatggcgtggcaatcggagtttgagtttgtcggttattatcgggcgcattaaatgcgcgccgccggcgcgcgcgaccaccgcttcttccccgaggatgattccgatgacgacgctgccttcccgtttgccgctgatccaggccccgatggtcggttcactgagcccgctcgcgatcgccgtgtgcgaagccggcgggctcggctcgctcgcctgcgcggcactgggtccgcagcaattgcgcgacgagatcgcggcgatccgggcgcgcacgcccgccccgttcaacgtgaacttcttctgccatacgccgccggcgccgatgccgcggtcgacgcgcgctggcgcgcggcgctcgcgggctactacgcggaagccgggctcgatccggccgacgtgaagggcggccccggacgcgcgccgttcgacgatgcgatgtgcgcggtcgtcgaagagctgcggccggccgtcgtgagctttcacttcgggctcccggacgatccgctgctcgatcgcgtgcggcgcacgggcgcgcaggtcgtctcgtccgcgacgaccgtcgaggaagcgctctggctggatgcgcgcggcgtcgacgcgatcgtcgcgcagggtgcggaggccggcggccatcgcggcatgttcctgaccgacgacatccatgcgcagccgggcctgttcgcgttgctgccgcagatcgtcgacgcggtgcgcgcgccggtgatcgccgccggcgcgatcgccgacgggcgcggcatcgcggccgcgttcgcgctcggcgcgcgcgcggtgcagatcggcaccggttacctgctgacgccgcaggccggccgctcggcgcagcatcgcgcggcggtgcgcgccgcgcgcgacgacggcacgcgcctgaccaacctgtacacgggccgccccgcgcgcgggctgctgacgcgcttcatgcgcgaacaggggccgatgagcgcgctcgcgccggcgtttccgctcgcgacggccgtggtcgatccgctgcgcggcgcgttcgagcggcagggccgcgacgacttctcggtgctgtggtcgggcgaggccgcggcgctcgcgcgtgaagaggatgcgggcgagctgacgcagcgcctgtggcgcgatgcgctggcatgtgcggcggggctgcgcgacgcgtttccgcaggcgcgctgagcgaccgggaagggggcgccggcgcgggagcatcggcgtatcatctgggttttcgtcagcccgatccaggcacccccaccatgacctccgtcgacactacccccgtcctcgaccatgacaagctcgttaccttcatcgagcgcaagtggaacgatgaaatcctccacgcactgaccgactacatcgcgatccccgcgaagagccctgcattcgaccccgactgggcgaagcgcggttatctcgagcgcgtcgtcaccgatgccgcgcagtgggccgagcgacagcccgtgaaaggcctgaagctcgagatcgtgcgcctgccgggccgcacgccggtgatcttcttcgaatcgcccgccacgcgctcgggcagcaccgacacgatcctgctgtacggccacctcgacaagcagcccgaattcgacggctggcgcgcggacctcggcccgtggacgccgaagtacgagaacggcaagctgtacggccgcggcggcgcggacgacggttatgcgatctacgcgagcctcgccgcgctcggcgcgctcgacgagcagggcatcgagcggccgcgttgcgtcggcctgatcgagacctgcgaggagtcgggcagctacgacctgctgccgtacgtcgacgcgctgcgcgaccggctcggccaggtgtcgctcgtcgtgtgcctcgattcgggcgccggcaactacgaccagatgtggctcaccacgtcgctgcgcgggctggtgtccggcgacctgcagatcgaggtgctcgaggaaggcgtgcattcgggcgtgttcggcggcatcgcgccgtcgagcttccgcgtgatgcgccagctgttcgagcgcctggaagatgcgaagaacggcaacctgctgccgggcgtgttccattgcgagattcccgacagccgcgtgcgcgaagccgacgcagccgccgccatcctcggcgacgccgtgtggaagggctgccgtgggcctgcggcgcggacggcaagccggtgctgccgaccacgaccgatccgcgcgaggcgctgctgaattcgacgtggcgcccgtcgctgtcggtgaccggcgcggccggcatgccggcgctcgcggatgcgggcaacgtgctgcgtccgcgcaccgcgttcaagctgtcgctgcgcctgccgccgctcgtcgacgccgcgcaggccgtgcagcaactgaaagaactgctcgaactcgatccgccgtataacgcgaaggtcacgttcaagccggacgcgggcgccgcgacgggctggagcgctccggatctcgcgccgtggctcgcgtcgtcgctcgatgccgtgtcgcgccgccacttcggcgccgattgcgcgtacatgggcctcggcggcacgatcccgctgatgaacgtgttgcaggaaggtttcccgtccgcccagttcatggtgtgcggcgtgctcgggccaaagtcgaacgcgcacggcccgaacgagttcctgcacgtgccgtacgcgaagaagctgacggcggcggtcgcggacgtgatcgcgaccgcgcgctgagcgccacgactgcccgacccgacctgacggaaccttgccgatgaccgccttgccgacgcccgataccaaaccgctgcgcatgcgcgccgaaccgctgcatgcattcgtcgcggcactctgggaacgggccggcagcagcgagcgggaggcacggctcgtcgccgatcacctggtcggcgcgaatctcgcgggtcacgattcgcacgggatcgggatgatcccgaactacgtcgcgtcgtggcgggaagggcagttgcagttgaacgggcacgcgtcgattgtccgcgacggcggcgcggtgctgacgatcgacggcgggcgcggcttcggccaggtgatcgcgttcgaggcgatggtcgaagggatcgagcgtgcgcggcgcatgggcatctgcgcgatcgggctgcgcgacgtgcatcatctcggccgcatcgggcactgggccgagcagtgcgcgcgcgcggggctcgtgtcgttccatttcgtcaacgtgccgggcgacctgctggtcgcgccgctgcacggcaccgatccgcgcttcggcacgaacccgttctgcgccgcgtatccgcgtgcgggcaggccgccgctgctgctcgatttcgcgacgagcgcgatcgcgtacggcaagacgcgcgtcgcgcacaaccagcgcaagcgcgtgccggccgggtcgctgatcgaccatcgcggccagccgaccgacgatccggccgtgatgcacgagcagccgttcggcgcgctgctgccgttcgggctgcacaaggggtacgcgctggcggcgatgtgcgagattttcggcggtgcgctcgtcggcgggcatacgacctacggcgacacgctgcagaagacgagcgcgatcgtcaacgggatgctgtcggtgctgatcgacccgaaggcattcgatgcggccgatgccgagcgtgaggccgatgcgttcgtcgcatgggccaaggcgtcgccgcaggccggtgacgcgccggtacaggtgcccggcgagccggaagagacgagccgcgcggcgcgcgggccggcggcattccggtcgatcgcgcgacgtggcggcagatccgcgagagcgcggcggcggtcggcttcgacgacgcggcgctcgacgcgtggacgcagcgttgcacggagcgcgcatgagctggcaatcggagaaggcgcacggcgaggagatcgcgtatcagctcgcgccgctcggcaaggtcgaggtcgcgcggttcttcagcggggcggcgatgcggctcgatggcgtgatgttcggcttcatgtcgcgcgggtcgctgttcctgcgtgtcgacgacgtgaaccgtccggcgttcgtcgcggcggggatggggccgttctcgtatgcgaggcccacgcgtaccgtcgcgctggagggctactacgaaaccccggccgacgtgctcgaggatgcgggtgcgctgttcgactggtgccgcagcgcgtatcgcgcggcgctgctggcggggccgccgaagcgaaagacgagggcggcggcgaagccggtgccggaggcggaaccggtggcgaagcgggtggcgaaagcgacggcgaagccggcggagaagtctgcggcaaagccggcagtgaagcgggcaacgaaaccggcggccaagccagcggcaaaggcggcagcgaaaccgacggcgaaaccagcagcgaaaccagcaactaaaccaccggcgaagcgcaagcaaacctgatgccggtcgagcgaagcgacaccttcgcgaatttcgctttcctttctttcgatctcgaacgtgtcggggcgattcgcgcgacgcgcggcgcatgacgggtgccaggcggtgcgcccgcgcaggcgcgttaagtcatgcggcttgccgcaccgcacatccccgtgcttcacaacggcggccccggcgtttatgatcggcgcgggttgcacccgtgactggcgcgacccgcgccggcctcgccgccggctccaacgaacggcgcatcgtatgccgcgcgggacgcttccccactcatcattccagacggagacaaccgatgctcgtcctgattctcggtttagcgatcttcctcggtgtgcactcgatccggatcgtcgcggacggctggcggtcggcgacgatcgagcgaatcggcgagaaaggctggaagggcccctatgcgatcgcatcgatcgtcggcttcgtgctgatcgtctggggttacggcatcgcgcgccagggcgcgacgctgctgtgggtgtcgccggtcggtgtgcgccacctcaccggcatgctgaccgcgatcgcattcgtgctgatcgccgcctcctacgtgcccggcaaccgaatcaagacgctcgtcggccatccgatggtggccggcgtggcggtctgggcgatcgcgcacctgctcgcgaacggcacgctgcacgccgtcgtgctgttcggcgccttctttgtctggtcgctcgtcgatttcgtcgtgtggcgcgcgcgcgaccgccgcgaaggcgttcgttatccggcgggcaggctgtcgggcgacgtcgtggcggtcgtggccgggctcgtcgtctgggccgtcttcgtgctgttcctgcacggctggctgatcggcgtgcggccgttcggctaagccgccaggcacttgagcggctgagccgccgaggggccgaagccaagcggttgagcaactggctggccgagcggcgccggccagcgcgccgcacgccgagggcaacggtcagcgcagcttcgcgccggccgtttcgccgagttgcgccggcttgcggcgcaggaaatacgccgcgacgatcgcgagcgccgtcgataccgtgaccagaactggaagcgcgaatccgggttgaatgcctgcgagccgagcacggcgacgagcgccagcagcgcgacccagttcgacaccggatagaaccacgcgcggaatgccgccgggtcgcgtcgctcgtgcttcgtctgccggcgcatcgcgaagtgcgcgacgatgatgaagatccacacgatcatcacgaacgcgccgctgcttttcgcgagcatcaggaacaggtcgccgccgctcacgaagtgaacgccgaggatcgacacgcagatcgcgaggcacagcacgagcgcgttcatcggcacgcctttcgcgttggtacggccgaacatcgcgggcgcgtgcccgcgctggctgagcgagaacagcatgcgcgagttcgagaacaggaacgagttcatcaccgacatgaacgacacgaacagcacgatcttcatcgcgacggccgcgcccgtgaagcccgccatcccgaacagcgacacgtacggcgatttcaggttggccttgtccgtccacggcatgcacaggatcaggatcgacaccgagccgacgtagaacaccatcacgcgcacgatcacgctcttgatcgcgcggatcacgttcttgctcgggttctcggattcgcccgccgccacggccgcgatttcgctgccgccgagcgagaagatcacgaccatcacgccggcaagcacgggcgaaatgccgttcggcatgaagccgccgtgatccgtgaggttcacgagcccgggcgccggaatgcgcggctggaagccgagcaggatcgatgcgccgagcgccatgaacacgacgatcgtcgcgaccttagcgaacgacagccagtattccgcttcgccgaacgagcgcaccgagtacgcgttgctcgcaatcagcgtcacgagcatgaacagcgcgccggcccacacgggcagccacggcaggaaatcgttgaggatcgcgccgagcaggatcgcctcgacggtgatcgtcatcatcgacttgaaccagtacagccagccgaccgcgaagccggcccattcgccgagatagctgctcgcgtaggtggagaacgagccgctgtcgggattgcgggacgccatttcgccgagcatgaacatgacgagcgtgacgatcacgccgccgatcaggtacgacagaatcgccgcggggccggcggtcgcgatgatcgcgccggagccgacgaacaggcctgcgccgatcacgccgccaagcgcgatcatcgtgatgtgccgttgcttgaggctttgcctcaaagaattgtcctgcatctcctacctctagttattgttggccgggaacgcatcgggcagcggcggcaacgttctgccgccgcagggcgccgatgtcggggagcgtgtgtgacgcgatgtgccgggccgccggcggtgagtcggaatggcggccgcgaagtgccggtcggtgcccgcgagagggcgatgacgacggcaacccggattgtgggcggacaccgccgtcaccgcaaacgagatatgagaaagacgtcttgcggtttgctcatcaattgccgtggtggcgacaagcgtgtgcgtgggtcagatcggcttgacgaacaacccgatggtcagcaatgcgccgatgcagacgatcccgatccgcagcacgcgttcgttcacgcgatgcagcgcccacgtgccgagcagcccgccgacgaccgcgccgccgccgagcgcgagcgccttgccccagtgcaggtgcggcgacgtcaggaacagcacgacggccgatgcgttcatcacgcctgcgagcgcgttcttcgtcgacatcgcgtgacgcggcgacaggccggccatcgtcagcacggccatcatcaggaagccgagcccgccgccgaagtagccgccgtagatcgcgatcatgaattgcgagaacgcggcggggacggtgccgaggtgggccgtgccttcgcccggcttgcggaagaaactgccccacgcgaatacgatcgtcgcgaacagcacgagccacggcacgaggcgcgagaagatcgacgaaggcgtcttcagcaacagcagcccgccgagcgcgccgccgaccacgctgatcgcgaacatcgcccgaaacgacagcttgccgacgccgcgcaccatgttgcggctcgcccagccggtcgtgacctgagcgggaaacagcgcgaccgtcgacgtgatgttcgccgagagcggcgacatgcccgacacgatcagcgcgggcagtgtgacgaacgagccgccgcccgcgagggtgttctgcagtccggcccacaggccggcgaggatgacgagcgagcatgggtgcgcgaacggggaggtggctggaggcccgcttgccggaagcgggcaggcgcggcggacgctcgatggtaatgcaggatcgcggacgcaggaaggcaggccgggcgttctgcgcgatgcggtgcaggtcgtggcgtgtcgacgcgctgttgcgcggcccgtcgatggcggccgcgccgattgcaatcccggcggcgacacccggacgacgcatgtccgctcgcgtgggagatcgccatggaaagcgggatttaacgcttcattacgataggtttaccggaaaggtgctaaattcgcgcatcgatatctcgaaaagtggcgagggtagacagatgctgaagaaatgggccggaatggcagcgatggtcggcgcgatggtggcggtctcggcgcctgccgtggcaggtgacacgaacaacgcactgggcggcgcgctcggcggtgtcgcgggcgcggcggtcggcaacgcggtcggcgggagcacgggcgcgatcatcggcggggccgtgggcggcggcgcaggcggcgcggtgacgtcgaacaagcgcgaacgcacgggcgccatcgtcggcggcgcactgggtggcggcgcgggcaccgcggcgggccacgcgatgggcggcacggcgggcgggctcgtgggcgcggccgtcggcggcggcgcgggggcggcgctgggcggccacgtgtcgcgcaacaactcgcgctccgacgattactatcgcggcggcaagcacaagaaaagaagcaccacaagcacaacgactgaccggcggttcccggcggcctccgatggcgccgggttaccgtgcgcgaacggcaacggcggcgctcaggccgccgttgccgttttcggtgatcagcgcccggagcaccaggtccgagatcgtgcgataggccgcgtcgaaatcgtcgctccccagcgcgcgcttgccgagcaccagcagcatctgcgacgcgaaatccgcatacgactgcgtcgctgcccagatcaggaagaacaggtgctcggcatcgacctgccggaccttgccttcgtctatccagcgttcgagcacccggatgtcgtcccgcagcaccgggatcagttgcttgcggatctcctttccgtaggtcttcgcgccgccgatgatctccagcgcgaacacccgtgatccatgcgggcggttccgggaaaattcgagtttggcgcggatataggccgacatcgcttccgccggctcgcgctcgggcgccgcgaactcccgcatcctgccgagccagtcccgcaggacgtcgtccagcacgcgtctgtagagcgccagcttcgtcgggaagtagtacatcaggttctgcttcgacaggccggccgccgccgcgatcgccgcaaccgaactcccttcgaatccatacgtggaaaacgactcctcggcggcggcgagaatggccgcctcgagggtatcgcgcagcgcttcccgccggccgggtggccgggcgggcgtttctgcggtcggcgcggacgggttcatcgctcgatcctccaccggcatgtcgggccggagccgccgtccgctcaacgcgcgttcgcttcgggataggtgatgtgttccggcgcgcgctgcatgatgaccttcccgccgcgcagcgacgtacgcaccctggcctgcttgcgaatcacttcgtagtcgctatcggcgtcgaggatcagcagattggccggccgcccgacggcgaggccgtaccggtcgccgagggacatcgcgttcgcgctgtgctcggtgacgaaatcgaggcaccgctgcaggtcttcgtatccgagcatgtggcacacgtgcaggcccacgtcgagaatgcgcaggatgttgccgttgccgacggggtaccacgggtctttgatcgaatcctgcccgaagcacacgttgatgccggcgcgatcaagctccgccacacgcgtgatgccgcgccgcttcgggtaggtgtcgaaacgcccctgcaggtggatgctttcggtcggacacgaaatgaaatgaatctccgaacgtttcagcagccggaacagcttcgagcaataagcgttgtcgtaggagcccatcgcggtcgtgtggctcgcggtgacgcgcttgcccatcccgcgtacccgcgcttcctcggcgagcacttccaggaagcgtgattgcggatcgtcggtttcgtcgcaatggacgtcgacgaggcagcccttgcgctccgcgagatccatcaggaacttgatggagctcacgccctggtcgcgcgtgttctcgaaatgcggaatgccgccgacgacgtcggcgcccatctcgatcgcgcgctccatcaacgcgcggccgttgtcgaacgattcgatgccttcctgcggaaacgcaacgatctgcaggtcgatgagatcgcgcgcctcttccctgacctcgaccatcgccttcaacgcggcgagcgtgggatcggtgacgtccacgtgcgtgcgcacgtgctggatgccgttgtcgcgcagcatcccgatcgtcgtgtgcgcgcgggctttcgtgtcgtcgtgcgtgatcgtggccttgcgctggccccatcgctcgatgccttcgaacagcgtgccgctcatgttccattcgggttcgccggcggtcagcgtcgcatcgagatggatatgcggctcgaccagcggcgggatgacgagattgctgccggcatcgatgacgtcgttcccttgcggcgtcagcggcgacggctggaggtcgatcgcacggatcgtgtccgcatcgaggtcgatcgtgaagaggccgctacggccgcgcaatctggcgttgatgatcttcatgtgggttcctgtcgttcgagtggggccggaagggcgcgcagcggaatcattcgccctggacggacggctcgcgcgagaacgcgcgggcaacctgcaacagcacgatgtacgcggcggcggacgccgcgatgccgacgatcggcgcgatccacggcgaggtgtaggcgagtatcgcaccgatcgcataggcggccaggccgaccaggttgaagcgcggcaggcgggcggtcgcaagcggcgggtaggtgccgcgatggcggtaccagtagtccgccatgatcacgccgccgacgggcggaatgatcgagccgagcagcacgaggaacggaatcagcagctcgtacatcccgccgaccgcgagcacgatgccgatcgccgcccccacgaggacgagcgtgcggcgccgttcggtgcgcagcaggtggcagccggcggcggccacgttgtacatcgtcggcccctggatggtccagagattcaggcacagcatcacgaccgccgcgatcgacaggccctgcagcatcatcacctcgacgatgtcggcctgctgatagacgatcgcgcagtacgcgcccgcgacgatcatcaggccgttgcccgcgaagaacccgatcatgctggccgacacggcactgcgcgcgctgcgggcgaggcgcgtccagttggtcgcctgcgtggcgccgctcgcgaaggtgccgatgaccatcgtcaccgcggccgagaactgcatcggatgcgtcggcacgacgtgtttgaggccggcccatccgccgatatcgcgcgtggcgatccacatcgacgtcatcagcagcacgaacatcaacggcacggacacgcgcgacagcacgtccatgccgcgatagccgatgatggccgtgatcgagaatccgaagccgaacaggatcatcaacggcgtggtcaccgacgcgggccagccgagcagcttgaccagcacgatggcgaccgtcgcggtgccccacgcgtaccagccgagttccgcgaagccgagcaggaaatcggacagcttgctgccgacttcgccgaagcagaagcggcccatcagcaccgcattcaggccgctgcgcgcggcgatcagcgcaagcgacgccgcgtaggcggcgagcagcaggttaccgatcacggcgatctggatcatgctgacgacatcgaaggcgacgccgatcttgccgccggcgaacatcgtcccggtgaagaacgtgaagctcagcagcaccatcgtgatcgatagaaagccggtgcgtttctcgagcgggacttcgctcagcgcgaattccccgtggttcgatccggcagtcgggcgtgcatcctggttcgtgggcatctcgttttccgtgggcgatcgggttgtgggctgaaggaggttgcggaggcccgtgcacgggcagcggacgggctgtttctgtttttgtttcagcgcgtcattctctctggccaaaatttttacaagcgtaaaaatttggtgtgcacggcggtcgcgaagcggctgccgggaaagcgtgccgcggttgaccacccgggggcgctgggggcgttgtgactgcgggaaccggcttatccgggattgacgtgacccgcgcatcgatcggggcgaggccccgatcccggcgaatcgctggattcgaccgggaaagaacgtggcctcgattcaggccgacgaactaaagttgccctattttggaatgctggggaaggcaggcgtatcaagcttcgccggtgccgcacacttcctgagagcgcaactttagttccaaaatttcggaactgaagtttggacaaagttgatgcgtgaactaaagttgcgcgatttctgccatgcaggcgaatgtgtttggcgggaactggattgtcttgtgtgacgacatgtatcagttgaggacaccggcaactgcgttcacattcggtgaacggtcccttggtagttggattgggaacatcctatttgtctgattagtgggtgcaacgtcttgcgacgaaacgagtcagtcagggccgtctgactactgacattggtctagttgacagttgcggcgcgactcgcggaatcgacttggaggtggcggcgggcgatatcgatgccgctgaggctgtggactttgcggcccaaaagatcaatctctaagctaagccctccggaatgcaggcgggatatttcaatttcccttcgtcatagcagtggtctggccaccgtgtctgctccactaacgacatttcgctttcctctagttgatgcactttctgcatcacaaggaggtccatagaggcgaattggtggcaactgcggatcgcgttgattcgaattattcacggagcagactttgctccgactttgtagaacaaaggaaaaataaagccgtggcgtcaactgaagttggatagcgtgtgcattgcagacgcatcggttcctgaacggacacaattagcagtatctacgaacttcaacaaatacatggactacctccaaagtagtccaagattttgtccgcatcctccggacgcagggccgcaatcctgaccttcaaaccgtcgtgcaaacgaaggtttggcaccccgaggcgtccatgcgtgctcgacggaaggcgagcaggacctcaaggccgcacggacggcgcaagcgccagggcggtttcgagcacggcccgtccgaatgtgcgggcgtatgcggtcgcatcggcgtcgtcacgcggtcggtcggcgctctccttgaacggcaattcgatggtcatcgccagcgcatcgaattgctccgcgacccacgggatgcacttccttgggctcgcgtggtcaggtcggtcgacggaatagccgcgcgctgtctggaacacggggagcgtcgcagcaggtcctcgtcgaacgtgcggcgcagggcctgcaagcgtggcgtccaggcggggctgccgtcggcgcccaccgagaagacgtggggcaggacctcgtcgccatggaagtcgacgagcaggtcgagtccgagcgcttgcatgcgacggcgcacggcggccgtctcgggcgcatcaggatactcgcggtcccagcagcggttgaggttggcgccgcgcgcgttcgtgcgcaggttgcccaggcgcacgccgtccggattggcattgacgacgacatgcacggctgagccaccgttctcccaaacaggacgcagctcgccgcacagcccctgcacgaggccctcgaggcaataaccgccctgcgattcgcccggatgctggcgagccatgaaccagaggcgagtgcgtggcgcatcgccctcgaacgagagcatgcggatcggctcgccgagcgcggaggtcccgagggtctccagcgttgcgcctgcctgcgtcgcctgagcgacgaggttgtcttcggcgacgcggtcgaaggtcggaaaataggcaaagcgcaggcgccgggccgggccgggcgcgtggaacgcgagcgcatcgccatcgaagtctgttggcaggcggcgccaggccgccgcctcgccgccatcggcgcgcatgcagacgcggtagtcgacccagcctttagggtaggacgagccggccaaaccctcgatgcgcacgtcgacgccgccgggcggtagatcgaccagctcgaacgcgaaccattgggcgaattcggcggcgttgtcgctgcgcagacgcaaacgcaggggcgagccgctggtgggagaggcaacgtgatcgatggcggcggcttcgaaatcggtgtcgatgtgcataggtctggtgttaggacagtgtcagggcctgcaggcttacaacgcgacattttgcgcgccgttgatgcaggcgtttgtggcacgggacgaaggtgccgcagcggacgcgagatccgccagcagcagatccacgacgcgggcagcgtgagctgcgttcagcacgaggttactggtgagcaagaacacgccttgcgtactgttcccgatcgcgaataatcggtgcgcgcttccgtgagcgccgatcacgcggttggtgtgcggatcgacgtcgatgccgccgaaagggtgacgacgcgcgagcccccggcgatcaggctcggatagagcggcccggccgacgcgtccgggccgcccaccagaccggtgcagttcacgagcaccggcacgcgcagatccggggccagcgtcggcccccgttccgaagcgcagcacgaaggcctcgccgtcgtgagtcacctcccattggtgttgattcctggccgcacaacttgctgggttgtgtcgagcgtgtgtgaggcttgaccgggattctcaaaaatccgccgcatctcggcctaaactgctcattttaatgaaaaatcaatgctcggatcgagcggcagaacaggccgcaggaggtccagcaggtagtcgccgagccggggtgtaagccggccccaagatttgtttggagttctttcaatttggcagaccagcggctatttgcgggcggcaaaggcctgattcatcccgcgcgcgctggacttcgtcgccatgaggttgcaagtcgacgccggaactctggatcatggatcggacgccccctgtggctagccgccgcaacggagcgtcgattgtgccttgatctgagtgcttgagccaaacacatagtcgggacggtgcgcggcgaatcctggcttttcttgcgaggtcgagtttgacacccgaagttgctcgattcgtgcgaattgttaaattgcaccgaaacccctgaaaagagcgcaactttagttcgtcggactgattcgtcagaccaattggcgattttcctcccgcttgctcccgtgaaattgtcatgctagtttttcatgaaatttctcggcaataatttcacgggagtccgcatgttcgtgcagtccgaccgtcacgtcgcaagctactacgccggtacgtatccggagccgatcccgcatcgtccggaactggacgagcgcatcgacgccgacgtgctcgtcgtcggcgcggggttcagcgggctgcatacggcgctgcgccttgcgcttaccggcaagcgggtcgtcatgctcgaagcgagccgcgtcgcgtgggccgcgtcgggccgcaacggcgggcaggcgctgctcggttggtcgtgcgacatgcagccgctcgaggattcgctcggccgcgacggcgcgcgcctgctgtgggacagcatgcgctgggccgcgaccgaggtgcgggaactgcccgggcggcatggtttcgacatcgactatcggcccggcagcctgtgggcggcggtgcggccgcgccgcgtcgcgatgctcgcgcaggcccgcgacgaagcggccgagcgctggggctacgaccggctgcgcgtgatcgagcgggccgacatgcccgaatggatcggcggcacgcgctatctcgcggcgctctacgatcccgaggccggccacctgaacccgctgaagctcgcgcttggcctcgcccggacgatcgagcgcgcgggcggtcgcatcttcgagcagagccgcgtgctcgactgccgcgaaacggccgggggccacgtggcccgcacggcgcgcggtgaagtacgcgcggacgtcctcgtgctggcctgcaacgcgtatgtcgaccggctcgatcgcgacctcgcgcgccggctgctgccggtcggcacctaccaggtcgcgaccgcgccgctcgcgcccgacgtcgcgcgttcgctgctgccgcggaacagctgcgtgatcgacaaccagttcgtgcccgactatttccggctgagccccgacaaccggctgctgttcggcggcggctgcacgtatctcggcggcattccggccgatatcgcggcggccacgcgcccgcacctcgaacgcgtgtttccgcagctggccggcgtgccgctcgattacgcgtggggcggccatatcgacatcagcatgcgccgcacgccggacatcggccgcctcgggcagcgtttctggctgcagggcttttcggggcacggcgtgctgccgacgctcgcgggcgcgcgcgcggtggccgacgccgtgctcggcgacgaacgcctgcttgcgcagtaccagcgcatccgcaacccgcgcttccccggcggcgaccggctcgccgcgccgctggaagcggtcggcaaggcctggtaccgtctgcgcgataccgtttgactgcaccggaacccaccatgaacgaacaggaagagatagaaagcctggcgatcctgatccgcgacctgcgcaagcatcgcaaggtcacgctcaacgatctcgcggaacggatcggccgctcggtcggctttctgtcgcaggtcgagcgcgggctgtcgcgcccgacggtcgcggatctcaccgcgatcggcgaggcgctcggcgtgccgaccacttatttctacagcctgagcaagccgcgcagctgccgtgggtcacgcggcccgacgagcggcgcaccgtgtattacgcggctggcattaccgacatcctcgtgtcgccgaacatgcgctcgcgcttctcgatcctcgaaagccatctcgcgccgggcgcgagcagcggcgagcggcccgtcgacgacagcgacgagcagggcggcttcgtgctcgaaggagaactgacgatctggatcgacggcgacgacacacccgtcacgctcggcccgaacgacgcattccagctccccgcgcacaagcgcttccgttatgccaacctgaccgacgcgccgacgcgcgtgatctgggtattcacctgagtggtcggcggggcgggcggcatgacgggccgccccgccaagcagcctgtttgcagtactgatcgagatgatgcatgcgacgtgatgcatgcgcgtgaatccggttcgccgcgctgcggcaccgccatacaagacatggaaaggatgagacatggctgacgtcgttcccgcgctggtcggtgaagtccgcgcattccggcaggcgcaccccgagatccgttatgtcgacctgatctgcctcgacctgcccgggcatttctacggcaagcgctacccgatcgacgcgctcgaaaaggtcgcgtcgggctcgttgctgaagctgccgcagaattgcgtgctgctcggcacgcagggtggcctctacaagatcggcgactactgcttcaacgacggcgacccggacgcgccgcgccggctgattcccggcacgctgaagcccgtgcgctgggagcggcagccgctcgcgcagatgctgatcagctccgacggcaccgattcgccgatcgagttcgagccgcgcgaggtgcttgcgcgcgtgctgcggcgtttcgcggcgcgcggcatccggccggtcgtcgcattcgagctcgagttctacctgttcgccgcgcagctcgcggaagggatgccgcaatatccgcgcgaccgcctgagcgacgatcgcgacgatcagccgaacatgcatatcgagcgcctgtcgcggttctccgacgtgctgcacgagatggtcgaggccgcgcgcgagcagggtgtcgacgcgacggtgatcacggccgaactcggtccgggccagttcgagatcaatttcggccacaccgacgatgcgttgcgcgcggccgactggtcggcgctgttctgccgcagcacgcgcggcgtcgcgttgcagcacggctatcgcgcgagcttcatgggcaagccgtacctgcatgcgccgggcagcgggatgcacgtgcacgtgagcctctacgacgatgccgggcgcaacctgctcgcggcggacgggcagcggccgctgcggcacgcggtggccggatgcctcgcgctgctgccgcactgcatgcccgtgttcgcgccgaatcacaacgcgttccggcgctacggatcgatggtgaatgcggcgagccgcgcgagctggggcttcgaggatcgcgatgcgtgcatccggattcccgagtcggatgcgcgcaacctgcggatcgagcaccggctcgcgagcgcggacgcgaacccgtatctggtgctcgccgcgattctcaccgggatggagcatgggctcgatgcacggatcgagccgatcgcgccgctcaacgaggatcgcggcagcggatcgatttcccgaaggagatgctgtcggccgtcgcggcgatgcaggatcatccggccgtgcgcgaagggctcggcagcgagttcgtgatggtgtattgcgagaacaagcggcaggaggagctggattttcgcaatgaaatcggcgcgcgggagtatcggtggttcttgtgagcggacgctgccgcgcgcgcgtcttatcgtccgcgcatctgctccatcggcaggtgcgcgccccacgcgctcgtcagggcctcgatttccgcgaccgggtcgatctggtgtagagcgctttcggccacgccgtcgccgaacagcaggtgcgcgaaatcgcgtgcacgctcggtgatcgccgctgttttcgggcggcgccgcagcgtgaaagacgagagcgccgcatcgaggtcgctgtcgttgcctgctccgtgctcgtcgagacaacggccaagatgccacgcgtcctcgagcgcctggcaagcaccttgtccggacgtcggtagcggggcgtgagcggcatcgccgatcatcagcacgttgccgcgatgccacacgtcgaccggatcgagatcgtgcacgcggatcttcgtgatcgcgtccgacggtgtcgcacgtatcgcgttcgcgacgggtgccggccacgcagcgaagcgccgttccagcatcgccgcgggatcgctttccgtcacctcgtccggatcggcttcgggccatgccgccgcccaatacatccgatgccggtcgagcgcgacgatgccgaagcgctcgcgcacgccccaatagtcgaataccgacacctcgtcgaccagcggcacatcactttgcgcgataccgatccagttgacgaatccctggtagacgggcgcgttgtgaccgaccacgtagtgtcgcgcgacggagttcatgcggccgtcggcgccgatcacgagatcgggggcgatcgtcgttccgttgtcgaagcgaacgacggcgcggccgtccgttccggtttcgatggccgtcgcctcgtggccgaagcggacgtcgatgccgcgcgcggcgaggtgccgtgccagcacggcctgcaggtcgcgccgcaggatcgaatacgtcgggaaacccatgcggcggtcgagtgcgcggatatcggtagccttgagcgcggtgccatgccggtcgatgcgtcgcatcgtatgcaggtggccgccaacctcgacgatgtccggcagcaggccgagttgctcgagcacgaagccggcattcggccacagcacgacgcccgcgcccatcgtcgattccgacggccggcgttcgtacaaccggatccggtggccgcgcccggcgagtgcgagtgcggtgctcatgccggcaacgccggcgcccagaatggcgatttccatcgtgctccttccttgtgtcgtacgcgtgctcgccggggcgcggagttgcgcatcggcgtcgcattgacgggatgagcatcgtaaattatggtctccggcgggataagccgtgaaaatcggcacgctttgatacctgaaatgggctaatgatgcgaagcaagctggatctgaatgcggtgcgtgtgttcgtggcagtcgtcgacgaaggcagcttcgccggcgccgcgcgcgtgctcgagatgccgggttccaacgtgagccgtcacgtggcgcaactggagtcgaggctcggcgtgcgcctgctcgagcgcagtacgcggcacttgcgcatgaccgaggccgggcgtttgctgcacgagcgcgcgcgaccgatgctcgatgcgctgacgcaggccgaatccgaactgacctcgcagcagacggagctgcgcggcgtgctgaagctctgcgtgcccggcgaaatcgggccgcgcatgctcgggccgatcgtcgcggaattcgcgagccgtcacccgcgcgtcgaaatcgactgcgatacgagcctcgccggtgtgtcgacgctgcgcgacgatatcgacctgtcgatcatcgtcaatcgcgggaggctggacgacagcgcattcgtcgtcaggccgctcgtgagtttgccgagcgtcgtcgtggctgcgccgtcgctcgtcgcgcgggtcgggttgccgacccggacggaacagctcgggcaactgccgtgcatcacgacgttgagcacgctgaaagggcagccgtggcagttcgccgacggcgacgggaggattcacaagatctccgtggcgagccggtatcgcgtcaacagcggcgagatggcagggctggctgcggtgaacgggatcggttttgcgattctcgtcgagcgcatgtgcgcggtcgagctggccgagggcggctggtgcgcgtgccgctggagatgacgcctgcgccgctggagctgtatgccgcttatgcgagccggaattcggtcaatgcgaagatccgcgagttgctgcagatgatgcagacgcggctagtggaatggggacaagcctttcatgacgatcgtgtcgccgtcttggcgggccacacgtgccggttcgtgcgcttgcccggtgtttcgttatcgagactgattgctcgcgccgtaaagggaataaaaccggtacggcagatcggccagttcgctttcgacgtgatcgtgccggccaagcgaatgaagccaatcgaggaacgtggcttcggtcatcaccgatcgtaacgtgtcgaccgctgcgtcgcgattcgcggaaggcacgaattcaacgggcgcggtgtggcggtcggtggagccgctcaagtagcgcgcgccctgccagtcgatgcgcggatagtcgcgggggctgaattcggacggctgccggacacggccgcggagcatgtcgtccgccccgacgaaccagatcatcaactgtgcacgccagagtggatcgtcgatggcgagcaccgatgtcagccacgggcgaatttcgtgcgtctcgaggtatttgacgcaaaggaacatcgatgacgagaattttccgctggcattgaaccagtctccggtgccggattgccggtcgtgatgccggttgaagcacgcagccgtatcgagtgcgcccgacggccagcattcggggtccatcaggctttgcccgagcgtatcgagcacgtcgcggcgataaccctgatagggttcggacgggatgcgatcgggatgctgcgaaacgaacgcggtgatcagccattccagcagcgcatggtgttgcccttcgtggcagcgcggcatcagttgcaccatcaggtagtgataccactgctgccactcgtcgcgtgggccgaatgaagtcgtgccgatcacgatttcttcgagcggcgtgtccagccgtgcgatgtcgatcgactggaggtcgtcctgcaactcggcgaatgtccgtcgcgagtcgcccatgaaccacgcctcgcccatcggcgtcttcgggcgcggaaacgccgcgctcagtctcgccgatgccgaagcggagcgcccggccccgggaatccagcgaaacgggtcgggccgggccggcatcaagatgttgccgcctcgccgtgtgccgtgcccggtagcgcgcgccaatagcgcacctcttcgataggactcccgtcgatctcgaacgtcttgacgtcgtcttcggcgacgaagccttcgcgttcgtagaacgccctggcccgacggttcttgagcaagacccatagcgatacccacgcatggcccaggtcgtgcaacgaccggcatgcatggtcgaccagcgccgcgccgattccctggccgcaatacgacggatgcagatagatcgcttcgatttctccccacgcacgatccttgtcggtgtcgcgtgtcggaccataggcgatccagcctgccggcgtgttgtccgcgaccgacaccgcgagtgcgacgtgcggccgcccggcgtcgaacgcacagcgccacgaggccgtgcgcttctcgaccgacaggccggcgaggaacgccgccggcatgatgtccgtgtaggtcgcctgccacgatgcgacgtggatgccggcgatggccggcgcgtcggcggaggtggccgtgcggatgtcgatcgtcgtcgtgttcggtgtcatgcgtgcctcgtcgaatcgtgtgccgtttgccgcgttgccgcgcgcggattcattccgccggatccaggctgctgtcgatcgcgaaacggtagccgaggtccacttgcgacgcgtcgcccggcgtatcggtccgcttcagcacgaactcgaacgcgggttcgtaccaaccgttgcgcggcacttcgccaccgaggatttcgacgtcgtaccagccgttgtcgaggtcgatcacgggccggcccggttcgcgataacgcgcaagcagcgcgttcaccgattcgtcgttgaagcgctcgagaatgcgccacgtgtaaagcatcaccgaacggtgttcgacgcgcagcacgtatccgccgcgccgatgctgcaggcggcttccggccttcagcagttcgggcgtgtcgtcgtccagcgtgaagatgaccgtatacggatggttctcgataccggccagcggaatgacgacgccttcgagcacggcgtggtcgccgctgtcgccggtcgtgaactcggacgcgacgttgtccggcagccgatgggtttccttgtagcgcttcagcagcagaagatcgccgacgaggaaacagtcgatcaggtcgttgaggacttcggagaattcatgccgcatcgtcgtgtctttcgaaggcggcgtgccgcgacctgcacggcggcacaccgcgtccggcgagcttactcgccgagcctggacgtcacgcaacccgtgctcgagcactcgcgctcacgctcgcgcaggaacgacagccgcgactgcgtcatgtcgttcgcgcactggatatccacgaggtagctgttgttgcgcgtttcgctgcactgcgcatcgcgttgcttcagccatgcgagctggccggccttcagcgcggcctgctggtcgccgctcagttgcttgcgcaggcggccgtattcgtcgttcagatcgcgatcggactgagagaactgcgtgctggtgcagtacacctggtcgaacgcgctgcgcggcttccgcagccggccgcgtgcgcggcgaacggaacggcaagcgcgagcagtgcgcaggatgcgagcagattcttctttttcatggtgatgctcctgactgggtgaaaaccgttgggcccgatgggcgattgcatcgtttattgcggcgcggtgcacgcgtcgatcccgcccgcgatcgcggcggacagcttctggatcgtctcgcgacgcgcaagccgtgcttcctcgtccgggttgacgatcacgccggcctcgacgagcaccgccggaatcggcgcggtgcgcagcacgacgagatcgtcgaagcggtgaatgccgagtgccgggtcgatcagcgggcggttctcgccgcggatcggctgcgcgtgatacagcgacggccgttcgccggccgcgaccagccgcccggcgatcgccttcgcgcaacgcaggctttccgcatagtgcggattgcgttccgacacgaacaccgagaagccgcggaattcgcgctgccggcccgcgtcgatgaactgctgctgcatcgagtcgtgatggatcgacacgaacaggttcgcgtcgggcgcctgggtcgagcgctggtcgagcgagatctcgcggccgtcggccgacgtgcgcagcacgcggtcgccatgcgcggcgagttttcggcgaccgccgcggacagatcgaggttgtacaggtattcgacgcggccgctcgcgccggtggagcccgggtgagcgggcgtatgaccggtgtcgacgacgatgtagcgcccggaggcgggcgcggtgccggcggtggccgcggtgtcggccgcatgcagcgccggcggcgcgccgagcagcgcggtgcaggcgagcacgcgtgcggcggcgcgcacgaacgggcgaaggcgtcggatggttcggttcgtcattgttgttgtcgaggagggcatacggcgcgtcggacggcacggcaccgtcggcctgctcaatgcagtcggaatgtcgcgcgattatagcggctggcggcggcgccgcaatgacggatgacgccggtcaggccagcacgcgccgggcggcgagcatgccccagtacgacgcttcctcgaacagcgacagcccggacaggtccgcatgcgcgaacacgacggggccgtcggcctcgcgcagcgcgagcagccccggccggctcaggaagccgacgtcgggtgtcgccatcgcatgaccgcgcacggtgatctcgagcgccgacgcgtgcttccagagttcgcgcccgtagacggcctgcaggtcgatcgccgcctgttcgcgcaacgcatcgggcctggcctgggcaagccagcggcgcgtgtcgtccggcgtttgcgtactcaacgcctgataggcggagaacaccgaacgcgtcggcggcgacattcggatcagcggtgcgtcgacacgacataaccgagcgccgcgccgtcgtacacgacgttgtcccacgcgagcggcacgcccgcttcctcggccggcatgccgtcgagcaggaagttggacacgagccacggcgcgcgcggcggcaggtcgcgcgcggggtcgaagccgtatgcgccgagctgcggaaacacgcgcgccgcgacgaacagcggcatcgcgctcacgacgcgccgcgccttcagcatgaacgtcgacagcgcaccgtcgttgccgacgcgcgcgcacagcacgtcgacgccgcccgcgcgttcggtcgcgcgcaccgcgaagccatcgcgcgaccacgcgccggagccggtgcgcgcggtgatcgaatcgctcagcttcgtcaccatcgtgtgcagcccgtcgggccaggtcagcaccgcgccgtcgctcgcatcgcccgcgtggccgccgcgcgacgagaagtagtgcaggccggcccacgcggacacgcgctcgtacccggcgccatagtcgtcacggcagcagtagttcaggtaccagtgcagcgccttcgccgtgtagccttcgtcgagcagccactggcagaacgagcgccggtccagcgcacgccagcgcgggtcgcgcgacgattcggcgatcgggatgcagaacaccttgcggccatcggcgccgcgcgcggtgcgcagcccgtcggtgtaggcaaagaacttcgcctgttgcgcgagttcgtctgcgccgaggccggcggtcggcacgatgccgtcctgccactggccggcgatgaagagccgttcgtcgggcgcatgcacgagcgcgcgttcgtcgtacacagggcgcgcggagaacggcgcggattcgatcatgccgagctcggcgagcatgtcgcgcaggtgcgcggattcgagcgacggcagcggcaggtagtgcgcgccctttggataaccgagatcgccgaagcggccgccggcggcattgccgccgaattcggggcccgcgagcaccgtgaagcgcgtgtgccctgcgcgcgcaagctgccatgcgcacgacagcccggcggcacccgcgccgaggatcgcgacgtcggtttcgatcgtgccggaaggcggcggcagcgtcgcatggtcgcgcagcgcatggccttcgcgcatgccggggtagccgacctgcggcgtcgtctcgatccagccggtgcgcccgcaggcggcgagcgatgcggcggccgacgcgacgaggaacgtgcggcggtccatcagcgcagcacgtgcttccagtcgtcgtcgaagcggcgcacgagcggctggtcgttgagttcgttcggcgacatcggcagcgccggcatgtcggccgggaaatggaacatctcggcggccgtctgcgcgtcgagccagcgggtgggcaccgagtagtgcgtcgggaccgtgaaatcgcggcgcttgccggcgatcacgaagccccagtcgccgaacgacggcacgtagcagtggtacggccacgtgttgagccccgcttcgtgcagcgtcgcgatgatggtccagtacgcgtgcggcgcgaaatacggcgacgtcgactggatcaccgcatagccgttctccgacaggtggcgcgcgagcagccggaacacgggcaccgaatacagccggccgagcccgaagttggtcggatcgggaagtcgaccacgatcgcgtcgtacacgtcggcgttcgattcgagccagcgtatcgcgtcgtcgttgatcacgtgcacacgcgggtccttcagcgagccctggttcagcttgacgagcggggcggacgtcgagaacagcttcgtcatcgcggggtcgagatcgacgagcgtgatctgttcgaggttgcggtgcttcagcagttcacgcaccgcgagcccgtcgccgccgccgagcacgagcacgcgcttcgcccacggcagtgcctcgatcgtcgggtggatcagcgcctcgtgataacgatgctcgtcgcgcgacgagaactgcaggttgccgttcaggtacagccgcatgtcgtcgtgccattgcgtgagcacgatgcgttggtacggtgtcgtttccgaatagatcgtctcatcgccgtacacgccgtgttcggcccagtgcgtgatgcggtccgacagcacgaagccggcgacgagcagcccgatcacgagcgacgcgcgcatcagcttgccgcgcacgttgcggatctcgtcgcggaacaggtgcgtcgtccacagcgcgacgaaggcgttcaggaacccgaacaggaagctggtgcgcagcaggcccaggcgcggcgcgagcacgagcgggaagatcagcgacacggcgagcgagccgagatagtcgaaggtcagcacttcgctgacggtatggcggaatgcctggcgacgctgctggaacgcgcgcatcacgagcgggatctccatcccgatcagcaggccgagcgcgagcaccagggcgtaaagcgccgcgcggaacggcgcggcgagccaggcgaacaccgcgaacagcagcgcggccgacacgccgccgagcaggccgaccagcagctcgatatcgacgaagcggtcgagcacgtcgtcgtcctcgacgaacttcgcgagccacgagccgatccccatcgcgaacaggtagctgccgatcaccgacgagaactgcaggatcgaatcgccgagcaggtagctcgacagtgcgctgctgatcagttcgtagccgagcccgcacgacgcgagcacgagaatcgacaggacgagcgcacgcttatgcagcatggcgcatccgttgtgcagtgttcggcaatgtggatatactggcgcggaattttgtccggtggccccgcgcgggccggccggcgacggggcggcgaaccgagcacaaaatccgagggaaagaatgaatagtgcctatctctatgcggttcatttactgtcggcgttcgtgctgcttcttgtgttcgcggcagtgtacctgaaggtcaccccgttcgacgaactggcgctgatccgcgacggcaacgcggccgcgacgctgtcgttcggcggtgcgctgatcggcttctgcctgacgctcgcgtccagcatcgcgcacaattccacattcggcgaagtcgtgatctgggccgtcggcgcgatggtcgtgcagctgatcacctatgcggcgctgacgcgcctgatgcccggcatgaatcatgcgatcgaggatcgcaacgtcgcgatgggcggcctgatgggcaccgcgtcggtcgtcgtcggcatcatcaatgccgcctgcctgacctgacgcgccacgcgtttcgaggagaccgacatgagtctgggatcgtttatccgcaagcagttcatcgacgtcctgcaatggacggaagacaccgacggcgtgctggcctggcgctatccgatggaagaccaggaaatccagtacggcggcaagctgaccgtgcgcgaaacgcaggtcgcgatcttcgtcaacgaaggcaaggtggccgacgtgttccagccggggctgtacacgctggaaacgaatacgctgccggtgctcacgtacctgaagaactgggacaaactctttcagtcgcctttcaagtcggacgtctatttttcagcacgcggctgcagctcggccgccgctggggtaccgcgcagccggtgacgatccgcgaccgcgaattcggtttcgtgcaggtgcgcgcgttcggcatctactcgtaccggatcgtcgacgcggccgcgttctatcgcgaggtcagcggcacgcgcgcgcagtacacggtcgacgaggtcgaacagcaactgcgcaacctcgtcgtgaccgcgatgagcacgacgttcggctcggccgacgtgccgttcgtcgacatggccgcgaaccagtcgctgttgtcgcagcgtgtcgccgacgcgctggcgcctgtgttcacgcgctacggcctcgcgctcgacgcattcgcggtcgagagcgtgtcgctgccggccgagctgcagaaggcgctcgacctgcggatcggcgcggggatggccggcgatctcgcgcgcgccacgcaataccagaccgcgcaggcgattccgctcgccgcgcagaacccgggcggcatcgcgggcgtcggcgcggggctcgccgcgggcgcggcgatcgggcaggcgatggccgggcagatcgcgggcgccgcgcaaccggcgccggccgcaccgcgcccgcccgctgcagcgccggtggcggccgcgccggcggaaggcaccgactacgtgcagcggctcgaacagctgaaggcgctgttcgacaagggcctcgtgaccgaagacgaatattcgcgcgcgaaggccgagatcctcgcgaagctcacccggtaagcgtcgcgcatgttcagtacctcgtgccccagtgcggcgcgccggtcgagtttcgctcggcggcggcggtgatggccgtctgcgcgttctgccgcagcacgctgctcaagcgcgggaccgacgtcgagcggatcggcgaactggccacggtgctcgacgatgcgtcgccgatccagatcggcacggccgggcgctacggcaagcgcacgttcacggtgctcgggcgcatccagatgacctacgacgccggcgtgtggggcgaatggtatgtcgtgttcgacgacggcacgttcggctggctgtcggatgcgtcgggccagtacgcggtgacggtgcgcgagcccgacgatgcgtccggcggcgcgtggcccgcgttcggcacactggagccgggcatgcggatcgaccacggcggccgcgcgtttctcgtgtccgacgtgcgcaccgcgcgctgcacgggcggcgacggcgagctgccgttccgcgtcgatgccggctgggaggcgcgcgtcgtcgacctgcggaccggcaacgcattcgcgacgtacgactattccgacgccgattcgaacggcgggagtccggccgtctatacgggcgaagcgctggagttcgacgcgcttgcgttcaccgggctgcgcgataccgacaacgacacgcgcgagaagcgcggtgcggagatggtgccgttcgcgtgcccgagctgcggcgcgccgctgtcgtatgcgccgaacgtggccgactacgtggtgtgcggcagttgccatgcgggcgtgcagtgcacggccgagcagcagaccgtgttcgcggcgcagcgcaagctcgaagcggtgaagggggcgctggagctcggcgcgatcggcacgttcgacggcgtgaagtacacggtgatcgggatgatgcgttgccgcgtgccgggcgacgaagagacgtgggacgaatacctgctgctgaacccgaagcgcggtttcctgtggctcgtgcagagcgaagggcgctgggagcgtgtgcaggtgctcgaccagtggccgacgatcggcagcgagtccgacgtgaccgacggcggcaagacctaccgcctgcgtgaggaatacgactcggaggtcgtctacgtggtcggcgcgttcaactggcgcgtgcaggtcggcgatcgcacgtcgatcatcgactatggctggcagaaggacaagctgacgcgcgagcgcagcgatgcggagatcgtctggtcgcgcgcgcggccgctgtcgggcagcacgctcgccgaacgcttcggcacgccggcgctcgcgacggcagcggccgcggcggcaacgggtgccaccgcgtcgaccggcctgttcggccggaaaggcccacagtttcgcgccgctgccgctcgtgttcagcgcgctgctcgtgatcctgaacatgggctcgctgttctcgttcagcggccgctccgtttacgtgctggtcggcctgctggtgctgtggctgcctgaatggctgtggaagagttttgcgtcggacgggggcaacgcgtgatccggtacatcctctacggtgtctacggcctgatcgtcgtcacgctgttcagctgcgcgtcgatcggcggcagcggttcgggcggcggtggctggggcagttcgtcggcccgcagcggttactcgtcgtacgggtcgcacaaatgaccgcgcgcgacgggatcgcgccgccgcgcgcgacgttcggctcgcacgtgctggccgacctggccggcatcgacgcggcgttgctgcgcgacgccgcacggctcgagacgctgctcaccgaagcggcgcggcaggcgggcgcgcgcgtgatcggcgcgcatttccatcatttcggcggcgagcacggcgtgacgggtgtcgtgctgctcgccgaatcgcacatcacgatccatacgtggcccgagcatcgcttcgcggccgtcgacgcgttcatgtgcggtgcggcgcgtgcggccgaggcggtcgatgcgattgccgctgcgctcggcacgcaggcgcaagtccggcagcaggttgcgcgcggcggcgcggcgacgtgagcggtcgttcgactctcgttgccgaaatgcaaaacagcatccgattcttcgcgttgctcggctgggcactgctcgccggccatgctgccgccgatgtgcagccgaaggcgcccagtccggtcgtgatggtgcacttcgattacgacgagaaggacacggcgcgccttcatgcgctggagcaacggctgggtcgcgcggtgaagcgggccggggccggcgaactgggcgagaccgagctgcatcgcgacggcaacgacgggtatctgtacctgtacggtgccagcgccgaccggttgtatgcggtggcgcgcccgatcctgaaatcgtcaggatggctgaccggcatggaggtgacgttgcgccgcgacgccggtgcgcagacgttcccgttgcgccgcgacggcgcccgttagtgcgtagatgatccgggcggcgcggccggtgccgcggccgtcgcgaatcggggcggaaaaggtgatttcatcacggccgacgttggcgacatgcggccggggcgtcatcgagacgacgcatcgctgcccggcgcgtcgtatccgggaggccggacaccgtgacactccggccgctaacgatcgaaccggaacgtcgacacactgtgcagcgtcgcgtcgtcggtgccgacgattccctgcgtccccgcgacggccgagcgcttgccgttgctcagcacggcccagtagcattcgccgccggccgcgtggaagccggtttccggatcgctgatgccgcacacgatcgtcgcgctcatgccgtgccagccgggaccggagaagcgctcgacttcctgcgggatgccggggccgtacgacgtcacccatttgccgtcatcctgcttcacgaatcccgcttccttttccgcgaccggctccagcgcgccgtcgacgatctcgaacgagatgaacctgctgctgtaggtcatgttgcggccgacgatcgcgacgcaatggtcgctgccgccttccgggcacggcttcttcacctgccggttcgcgaggtattcgaacgagatgccgagcgccgggtcgtggtaggtcttccagcccgcgtgtttcacctgcttcagcgctgccatgcgatcacggtacgcggtggcgatgcaggcggcgtcggcgcaggcatcgcgctgcgtgagccatgcgcgttgcgaccggatcacggcctgctgatcggcggcgatgccgactgcatcgaagtaggcgttcgacaacgcactgtcggccgacatgagtgcctcgtcggcgcagatcaggtgctcggtgcgcgtcgtcgcacgcgtgcaatcgatgccgtcggcgtgggccgacaacgagaggccgatggcggccagcgcgagaccaaggcgtatgccgaacacggacgactcctcaacgggttcgaacggcggccgtcatgccgccgtcgggtgacacaacggcgcacgcggttcgcgaagcgttgaacccgtgcgccatgcagcgggatacgacagggcgaaatcagcgattgatttcgtccgccgagatcagctcggccaccagcaccggcgccggcccccgcaggtagtactcgtgctcgagcggctcacgcagcttcatgaacgtttccgcgccgacctgcatcgtttcgcccgcatgcatgcgcgcgccgctttccagcaggtaatgcatcacgctgttgaagatgcccgaataacgctcgccttcgtgatgaccttccgcgagcgcggcgaaatccggcaggccgaacacgtcggcgccataggtgcgcatccacacgccctggacgccttcgacctcgtatttcacgaagccgcagaagaacaggttcagcgggatatttcgcagcacttcgaggctttcgtcgccgagttccttcgcgttgaaaacgcccgcgggcagcgacgtgtgcgcgtgctcgttcagcaccgcgaggccgttctgttcggccagcgcgccggcgacggccgccagtgcgacgtactggtcgagcggattcgtttcgtgccccgcgtagtagaggatcacgtggctgcggctcgcgcgcacctgttgtttcaggtcctgcccgtagtgggcgggcgcgacgcacgcttccagcgcgtcggacggatagggcgcatcgaagccgacgagccggacgacgtggttgccccagccggcgagcccgaacacctgcgagagcgtcggctcggtttcgacgcgcgcctgcttcatgctggggtggtacgcgcgcagtgcggccgtcagcgcggcgatatcgacctgcagcgggccgtcgaagacgaccgccacgctcagcggattctcgacgtcgggtgccgcggccagcgcgacggggttttcgggtacttccttgcggccaaagaatcgggatatcaggctcatcggattatgttcgtgtcgaagccgtttcagggagggggccccgttctctcggtcggggcgcgccgtcagggtgacggccgcccgtagtttccacgggttcggcgaatctggcaaatgcgcggtgagcgcgtggtggtgaggcgacggcgcgttcgaatgcgttcggcaggcggggcgcagacacgccgggccgtgcggcccgcgctcgccggtcagtgcggcagcgcttccgcttcggcccagcgcttgaacgaatcgagacgccggcgcgtctgcacgagatagaacgcgccgatcagcggttcgagcagccagcgcagccaggccggctgggcgcggaagtggtacgtgaatttcacctcggtcgtgccgggcgtgtgctcggtgaagttccagctgccgctgaagcgttcgagcactttcgggccgtcgaccatttcgacggccgcgacctgcggcggacggtacgagatgtagcgcgacaccatcgtcgcgcccgactggctgcggcagaacgcatcgacgccgacgtcggccgtcatgccgtcgagcagataggcatcggtgaggaagctgtcccacacgagccgccgcgcgtaatcctgcgaccacgtgaagaggcgcctgcgatcgacgccgacggtccggctgactgagatcctcatgatggcgggtgcaatggcgcggattgggatggaatcgagtgtaacccgccgattcggagcatttcttcatacttcgtcaagtcgagcaagggctcgattgacgccctccggatttccctaggattcacaccaacccttcgggaaagacccgaagcgtttcaatctcttgagggagcctcatgagtacgcaacagaaccggcgcttcgacgcgctcgttttcattggtcgtttccagcctccgcatcgtggtcacctgaacgtgctgaagtcggcactgagtcgggccgagcgcgtgtgcgtgctgatcgggtcgaccgacaagccccgcaccatcaaggatccgttctcgttcgacgagcgccgccagatgctggcttcgctgctcgacgcgtccgagcgcgaccgcgtgacgatcgcgccgttgcaggattcgacctacaacgacggcgactgggtgcgctgggtgcaggacgccgtcgcgtccgcgctcggtgacgtcgcgcagcgcaaggtcgggctgatcggccacgagaaggacgccacatcgtattacctgcggatgttcccgcaatgggagctcgtcgacgtcgacgcgacggaagacatttccgccaccgagatccgcgaccagtatttcgccgaacgcaccaacagcttcgtgcaatgggccgtgccggaacccgtgttcggctggctcgagcgtttccgcacgcagccggaattcgcgcagctgaagtcggaagccgaattcatcgccgcgtatcgcaaggcgtgggcggccgcccgtatccggtcacgttcgtgacggtcgacgcggtggtcgtgcactcgggccatatcctgctggtgcgccgccgcagcgaaccgggccgcggcctgtgggcgctgccgggcgggttcgtgaaccaggacgagcggctcgacgcggcctgcatccgcgagctgcgcgaggagaccggcctgaagctgccggagcccgtgctgcgcggctcgatcaaggatcgccaggtgttcgatcacccgacgcgctcgttgcgcggccgcacgatcacgcacgcgtgcctgttcaatttcccgaccggcgagctgccgcgcgtgaagggcagcgacgacgccgacaaggcgcgctgggtgccgctgaacgaattcgcgcagatgcgcaacgtgatgttcgaggatcacttcgacatcgcgtaccacttcctgggaagctgtgatccgctgattccccgcattccggtccgctgcgacagacgcggcggcacttcaacggcctagaggagctctagccatgcaaaacgatctcggcggctttgccgcggttcttgccaatccgatcctcaacacggattcgtacaaggcttcccacttcctgcaatatccgcctgacgcgcaggcgatgttctcgtacgtcgaatcgcgtggcggccgctacgaccgcacggtgttcttcggattgcagatgttgctgaaggaatatctgtgcaagccgatcacgcacgcgatgatcgacgaggcgcgcgatttcttcacggtgcacggcgaacctttcaacgaagcaggctggcgttatatcgtcgaacgctacgacggttatctgccggtgaagatccgggcggtgccggagggttcggtcgtgccggtgcacaacgtgctgatgacggtcgaatgcgacgacccgcaggtgttctggctcgcgtcgtatctcgagacgatgctgctgcgcgtctggtatccggtgacggtcgcgacgcgcagctggcacctgcggcagacgatccgccgcttcctcgaaaagaccgacgacgacctcgcgcaactgccgttcaagctgcacgacttcggcgcgcgcggcgtgtcgagcgcggagtcggccgcgatcggcggcgcggcgcacctcgtgaacttcatgggctcggacacggtgctcggcgtgctggccgcgaaccgcttctatcgcgagccgatggccgcgtactcggtgccggcggcggagcacagcacgatcacgtcgtgggggcgcgaaggcgaggccgacgcgtaccggaacatgattgcgagcttcggcttgcccggcgcgatcgtgtcggtcgtgtcggactcctacgatctgttcgccgcactcgacctgtggggcggcgagcttcggcaggccgtgctcgattcgggcgcgacgctggtcgtgcgtcccgattcgggcgaccccgtgaagatcgtgctgcagaccgtgcgtgcgctggacgcgtcgttcggctcgaccgtgaacggcaaggggcggcgcgtgctgaaccgcgtgcgcgtgatccagggcgatggtgtcgacgagctgtcgatcgaagcgatcctttccgcgctcgacgacgcgggttacgcggccggcaatgtggtgttcggcatgggcggcgcgctgctgcaacaggtgaaccgcgatacgcagcgcttcgcgatgaagtgctcggcgatccggcgcggcgggagtggcacgacgttcgcaaggatccggtcaccgatcagggcaagcgctcgaagaaagggcggctcacgctgctgcgcaatgatcgaaccggcgagtatcggacgacgacgctgccggttgcgtgggacgaccggatgctggaaggcgagtgggaagaggcgctcgagacggtgttcgatacggggcggctgctcgtcgatacgtcgtttgccgaggtgcgggcgagggcgcacgcagggaggtgtgacgcgggcggcggggtatcccgccgcgtcgttcgcgttcaggcggcgtgggcgacgggcgtgcacggcacggcgtctgcgtcggcttctcccgtcagtacgttcgcaggtgccgacacgaaattgatgtcgccttcatcgaaaccatcgagcgcgctcgcctgccgtcacgattcgcgggcgagcacgtgccccgccgtgtccgccgcccgcaccgcctccatcgcccgcgccagcgcatcgaacaccgccggccccttgcagcgcgacacgttgaagcgcatgaacgaggtcgcgccgtgcgacgcactgaacacgttgcccggcgcgagtaccacgtcgtgatcgagtgcatggcgtgcgacacgcgcggcatcgagcccgtcgggcaactccgcccacacgaacaggccgccgcgcggctccgtccagatcccgaggcctgcgcgtgcgaggcgccggatcgtctcgcccattgcatccgcgagacgtgcgcgcaggctgtcgagatggcgccggtacgtgccgtcgacgagcagccggtgcacgacgttcgcgccgatctgcgcatggccgaacgacgtcgccagcttcaggtcgacgagcgcatcgatccattccgggcgcgcggcgacgtagccgcagcggaccgcggccgacagcgtcttcgagaagctgccgatcgacacgacgcgcgacagcccgtcgaaggccgcgaggcgcggcgcgggcgtgctctcgaaatccgcgaagatgtcgtcctcgacgatcagcaggccgtgctcggccgcgagcgtcagcaggcggtgcgcgacgggcggcgcgagcgtcgcgccggtcgggttgtgcagcgccgcgttggtgatgtacaggcgcggccggtgctcggccagcacctgctcgaagcgcgcgagatcgggcccgttcggcgtgtacgggacgctgacgatccgcgcgcgatgcgcgcgcagcagcgcctggaagttgaagtagcacggatcgtcgagcacgaccgtgtcgcccggctccagcagcaggcggcacacgaggtcgagcgcatgcgtgccgccgtcggtcagcatgatctgcgcgggttccgcgtggacgccgtgctgcgcgagccgccaggcgagctgctggcgcagcgcgggcaggccgagcggcgtcgcgtaatcggtcagcgcgtcggattcgtcgcgcgacacggcgcgcagcgcgcggcgcaggctctcgtccggcagccacgacggcggcagccatccgcagccgggcttcacggtcgtcggcgcggcctcgagcgactggcgcgacagccacagcggatcgagctcgcgatcaagacgcgggccgagatcggcgagcgcgagcggcggcgcgtgccccgacacgtagaagcccgagccgcgccgcgcgacgagcacgccttcgctcgcgagccgctcgtatgcgtcgacgacggtcgatttcgacacgcccagcccgtcggccatcatccggatcgacggtacgcgcgcaccgggcatcagcgcgcggctcgcgatccgcgcgcgcaaggtgtccatcacggtttccacgcgcgtgcgcgacggcgcgggcggaacggaaagcggggcggaatggctcatggcgaagaatgaactgtacggacggttgtccagtacagtttgtcggaattgtattgggctgtagcttacgcgcttttcacgggcggcggatcatcggtgatccactttcccgttcaggatttcccgtgcaaaagacgaccaacggatggctcagcggcctgctgggcgtgatcatcttcagtggctcgctgcccgcgacgcgtatcgcggtgcaggggctcgacccgctgttcctcacgttcgcacgcgcgacgatcgccggcgcgctcggcctgctgctgctcgtcgtgctgaagcagcggcggccgacccgcgccgaggccgtgtcgctggccatcgtcgcgctcggggtcgtcgtcggttttccgttgctgacggcgctcgcgctgaagcatgtgacgtccgcgcacgcgatcgtgttcgtcgggctgctgccgctcgcgaccgcgctgttcggcgtgtggcgcggcggtgagcggccgcggctgccgttctggatcttctcgatcgtcggcagcggtgcggtggctgcgtttgcgttgcgcaacggcggccaggcatcggtggtcggcgatgcgctgatgctggcttcgatcgtcgcatgcgggctgggctacgcggaaggcgcgcgcctgtcgcgccagctcggcgggtggcaggtgatctcgtgggcgctcgtgctgtcgctgccgttgatgctgccgctcacgtggctcacctcgcccgcgtcgttcgacggcgtcgatgccgccgcgctgtgggggctcgcgtacgtgtcgctgttcagcatgctgatcggcttcgtgttctggtatcgcgggctcgcgctcggcgggatcgcgggcgttggccagttgcagctgctgcagccgttcttcggcctgctgctggcggccgggctgctgcacgagacggtaccgccgtcgatggtcgtcgtgacggtcgtcgtggtcggctgcgtggcgggcgcgaaatacttctcgaaagtggcacccgtgcggcgcgcgggctgacgcgcgcgcctgatggagggaatgggcgcgacccgtcgcaggtcgcgcccgttcgcgctcaatcgtccgggtgcacacgcgcaagcggtggccgtccgggtcgagcgcgacgaacgtcaggccgaacacggccgtcatcggcgcctgctcgaacgtcacgccgagcgccttccatgcttcgtacaggcgccgcacctcgtggtcgttgtcgaccatgaatgccagctccgagcggtggccggcgccgcccgacacgaaatcgcgcgcactggtcgaccacaggcccaggtgcagcccgttgtcgaacgtgaatgccgcataggtgggaaacgcggcgacgggcgggcgcccgaacaggcgcgcgtagaactgtgcgctgcgcgtcgggtcgtcgacatacagaagaacgagattcggagaggtcatgcggggccgtcctgggatcgattaagatgcgtcccattctatgaacggatgctgtcagaaaatggcagcatggaacgatgacgcgtgccgaacgattgctcgcgctgctgcaggtgctgcggcgccaccgccgcccggtgagcggccgcgtgctggccggggaactcggcgtcagcctccgtacggtctatcgcgatatcgcgtcgctgcaggcgcagggcgcggacatcgacggcgagcccggtgtcggttatgtgctgcgtgccgggttcatgctgccgccgctgatgttctcgcaaacggaactggaagcgctgatgctcggttttcgctgggtcgggaagttcgcggatgcgcagctcacgacggctgcgtccgatgcgctcgcgaagatctccgcggtgttgcctgccgagctgcgccgcgagatggaatgcacgacgctgctcgtcggcccgcgcacgatcgtggatcgggaaaccgtcgacatgggtgtcgtgcgcacggcgatccgtaccgaaagcaagctcggaatccgctacgtggatgaaggccggaaaacgagcggcgaacggatcgtgtggccattcgcgctcggctatttcaatgacgtgcgcatcctggcggcgtggtgcgaaggccggaacgatttccggcatttccggacggatcgcatcgtcgcgctcgaacggctggacgtgcgctatccgcggcggcgcgcggcgttgctgaaggcgtggcgtgcggcgggcgccgacgtgcgcgtgacggtgaggtgaggggcgaggtgcgcaggccgcgcaccccgttccgtcgtgccggccttactcgaacgtttcgagggcgagcaattcgtcgatcgtctgccggcggcggatcagccgcggcgtgccgcgatcgacgagcacttccggcgcgagcggccggctgttgtagttcgaggacatcgacgcgccgtacgcgcccgcgtcgtgcaggaacagcaggtcgccgatctgcggttgcgcgagcttgcggtgcgtgaccacgccgcccgcgtcctgcgtgaacacgtcgcccgactcgcacagcggccccgcgatcgcgaggtcgaccagcggccgtccggccggcagcgcgccatcgtgcgcgtgcaccgacaccgcgtggtagctgccgtacatcgacgggcgcatcaggtcgttgaagcccgcgtcgatcagcacgaaatcgtgcttcggccggcggttgacggcctgcacttcggtgacgagcgtgccggcttcggcgacgaggaagcggcccggttcgatctcgatgcgcaccgggtggccgagatgccgttcgatccgcttgcgcgcggcgtcccactggctgaagtagtgcccgacgtcgacgcgcggctcgccgtcgcgatacgggatcgacaggccgccgccggccgagatcgcgtcgatgtcatggccgagcgacgtgacgaggtcgaccatcgcatcgcacacctgcgacaggtggccgtagtcgacgcccgacccgatatgcatgtggatgccgaccagcttcagcccgtactggcgcacgatctcgatcgcgcgcggcacgtcgtcgatccagatgccgtgcttgctctgcgggccgccggtgttggtcttgttgctgtggccgtggccgaaaccggggttgacgcgcagccacacgcggtggccgggcgcatgctcgccgatgcgcgcgagcatgtcgagcgaaccggcgttgacggtcacgccgtgcttcagcaccgccgcgagcgtcgggcggtcgatcaggtcggccgtgaacacgacgccttccggctcgccggccgggctgaaccccgccgcgaggctgcgctcgatctcgccgagcgacacggcatcgacgcacgcgccttcctcgcgcatcagcttcaggatatggacgttcgagttcgccttctgcgcatagcggatcacgtcgaactgacgcagttgggcgatgcggtcgcggatgacgtcggcgtcgtacacccacagcgggtgccgtattgctgcgcgagcgtcgcgagctggcgggaatcgagggacatggcggatgaagcgggtcgaatgaacggataacgtgaatgatgcgcctgtttatctatgcagtaaaatgcctatttatcgaaattcgattcacatctgatatagatgatcatgctcacgcaccgccatatcgaggtctttcgcgcgctgatggtcaccggcagcacgacgcgcgcggccgagatgctctatacgtcgcaaccgacgatcagccgcgagctcgcgcgcatggagcaggtcgtcggcttcgcgctgttcgagcgcgcgcacggccggttgcggccgacgatggccgcgctcacgctgttcgacgacgtgcggctcgcgtatgtggggcttgaacgcgtcgcggccacggccgcgcgcctgcgcgagtttcgcgacggtcaactgtcggtgatcgcgctgccggcgttctcgcacgcgatcctcccaggcgcggcgcgccggtttcgcgacgcccatgcgggcgtcagcctgtcggtcgaaacgcaggaatcgccgatgctcgaagagtggctgaccgcgcagcgttacgacctcgggctgaccgagcacgacgtcgcgccggccggcaccgtgctcacgccgctgctcgaagtcgacgaagtatgcgtgctccccgacggccatccgctgctcgcgcaggacgcgatcgatctgccggatctcgccgatcgcccgttcgtgagcctgtcgctgaacgatccgtaccgcatcctgatcgacgaggcatttgcgcagctcggcgtggcgccgcgctcggtcgtcgacacgccgtcggccgtgtcggtgtgcgcgttcgtgcggcaggggctcggcgtcgcgatcgtcaatccgctgaccgcgctcgatttcgtcgggcgcgacctgcacgtgcggccgctcacgcggtcgtttccgtaccgcgtcagcgtgatcgtgcccgagcaccggccgaaaagcctgctcgtcgatgcgttcaccgatgcgctgcgcggcgaggcgaaggcgatccgccgccggttggccgcggtcctcggctgacgcggccgtatgatgggcgtttcgccgccatcgccgtttttcgtcttttccggaactgctcatgaccgatgcttccgcttccctcgaacaaccgattctcaccggcgaacgcgtcgaactgcggccgctcgaacgatccgatcggcaggcgctgctggacgctgccgcggacggcctgttgtggaacctgaaggtcacggtcgtgccgggcccggacacgatcgacgcctatatcgacacggcattgcaggggcgttcggccggcaccgtgatgccgttcacgatcgtcgatcgcgcgtcggaccgtgcgatcggcagcacgcgtttctggaagatcgatcgcaagaaccgcaagctcgagatcggccatacgtggctgagcgaatcggcgcagcgcacgagtgcgaacaccgaagcgaaatggttgctgctgggttatgcgttcgacgtgctgcaatgcgtgcgcgtgcagttcacgaccgacgagctgaacgagaaatcgcgcgcggcgatcctgcggctcggtgcgaagcaggaaggcatcgtgcggcacgaacggatcatgccggatggccgcaagcgcaattcggtgcgcttcagcatcatcgacgacgaatggccggaggtgagggtgaggttgatggagaagcttgcgacataacgtgtcgcgtatgacgcctggcgtgcgtcgcgtcgccggagggcgacgacgcgacggcaggaagaagccgtgcgccgcgcacgacgcgcggcgcggcggcgcgttactgcgccgatgcgaggtggtggcgctccgcgagcttctgcgcgtcggcgtaatgcttctgcaggatcggcagcgactggcgtgcgacttccttcagcttcgtgtcgcggcccgatgcgatttcggcctggaaggccgagatggccttctgctggccggcgagcgcgacctgctcgatgtacgccttgtcgaactcggcgccgcgcagggtcttgatgctgttcagcacggccgtgtcggggtcgttggcgggtacgtcgacgccgcgcgggctggctgcgcgcatcgcctggatgatcttttcatcgtcggccgacacgcgttgcgcgaacgccttgacctggctgtccgacgtgcgcgaatcggcgatgcgcgccgcgtcgtgctgcgtcgacaccgttttcgtaccgtccgtgatgaatgcctggtcggcttcgtggatgcgcgtcgcagcggcggccggtgcggccggtgccggttgtgcggtttgcgcggtcgccgtcacggcgacgagaagcaggccagcggcagacaaagcaaggcgcgagacgtgggaaagcggttcatagggacctcctttcaatcggggctctggttgaaaaacggatcgggtgatccgttgctgtgcgagaccgggcgcgcccgggccggattcgaccgccgctctgccgcggcgccggtcgaagtgtttcccggcccgactgattctaggagggcgatccggtagcaggtgcaaccgcgctgtggtttgtgtaacggttggtaagacgaatcgatgagcatgcgtgtcggcaggtattgcgtacctgtcgagtgcgtggcggcggcaattttgcgcgcatgcggcgtgcgggatgcgcgtgggtgtcatctggcagtcatcgtcacgccgcggtgacgcgcgcgtcgagcgtcgacgctggccggctcgcgatgcgcgcgaacgcgtcacacgcggtcgagcaatgcgtcgagacgcggcagcaacggcgttgcgcaatgtgcctgcaacgcgtccggcgcggtgtagccccacgcaacaccctggaatgcgatgcgagcgcgtcgtgccgcgtcggcgtcgcggatttcatcgcccacgtacagcacttcgtcgttgcgtaggccggcttcatgaacgagtgcgcgcaggcgacgtgccttgccgaacagcggaatgccgcacgcgaaatgttcgacgcggctgctggcgtgcgggccgagccggtcgcgcacgatttcctcggtgttcgacgtggcgatcgcgatgcggatgccgcgcgcggcgagcgcgtcgaacgtttcgctgacgccggggaacaacgccacttgcgcgacgcgcggccgcatcaggcgacgcatgtcgatcgtcacgcgcggcactttccacatcggcacgtcgagcgcgcgaatgatgtcgcgcgccgacatcccgcgcagtgccgggcgcagctcgggcgtggcgtcgcgaaagccgtgcatgcgcgacgcttccgacagcgccgcgagaaaactgtcgagcgaatcggcgagcgtgccgtcgaagtcgaatgcgatgaggcggtagggcatgaagcggcgtggcaggttatcgggcagacgacattgtcaccgaatcggagcctgtcgcccgcacggttggttgcgcccgcggcgaaacgagagggtcgagcagctgcttcgcgtcgtccggatgatcggtgctgtcccttgtccctcgctgcgctgcgcggtatcgtcgacgcttcgctttccaccaccccgaccggagaccgacgtgcctgctgccacccccgccacgctgagattttccaccgacaagcgcgaactcgacgtcgacgcgatcttccacttcctgcatcgcaacgcttactggtcgcagggtattccgcgcgacgtggtggagaaggcgatcgagggttccctgtgcttcggcgcgtatatcggcgaccggctcgtcggcttcgcgcgcctcgtgaccgatcacgcgacgttcgcgtacctctgtgatgtgttcgtgttgccggccgaacgcggcaacggctacggccgcgcgctgatcgaccacgtgttcgcgcaggagatggtgcagggcctgcgccgcatcatgctcgtgacgtccgatgcgcacgagttgtaccggccggtcggcttcgggccgtgcgcgaaccccgagcgggtgatggagatccgccgcccggacatctacgcgaaacgctgacgcgcggcgcagcgcatacaatacgcgctttccgtttttgccgaagagaaaccgatcatgaccgaacaggaagccgaacagctcgcgacgcatcgccactacaagggcgggctgtatcgctacatcggcgttgcccgccattccgaaaccgaggaatcggtggtcgtgtacgaacacctgtggccgcatgcgcgcgggttgtgggtgcggccggaagcgatgttcaacgggaacctcgaagacggcacgccgcgtttccgcaagctgcgcgactgatcctcggccggccgcgtaagccggccttgcgggccggctgcgcgagccgaatgtcgagccgaatgtgcgggtatcagtcgccggccagcgccttcaccagttccggcggtgcgtgccgggtcgtgacttccggcgtgccgtgccatgccgcgagtttcttcaccgccttcgcgacatcggcggcgagccccgtgccgaaccgcacgcccggctcgacatgtacggccttcagttcgaacgtgcggagcgtgcgatgcgccttcgcgtcgacgcgcccgaccagccggccgcgatgcagcaccggcaggcagaaatagccataacgccgcttgtgctcgggcgtatagcattcgatcgtgtaatcgaaaccgaatagcgtcgatgcacgccgccggtcccatacgaccgggtcgaacggcgacagcagcgtcgtgaccgtcgagcgcagcgtgtcggcctcggcggccggcagcaacgcttcgagcgagcgatgcacgtaggccggctccttccagtcgtcgatcgccaccgggatcaggtcgcccgcgtcggcgagctgctcgagctccgcgcggtacgagcggcgcggcagccgatagtagtcggccacccagtccgcacgcacgacgccgagtgcacggcacgtgtagtcgagcagcgcgggcagcacggcttcgcgcggcggcaggtcgcgcgtgtcgtcccagccgggcagcacgcgctcgcgcacgtcgtacacgcgctggaaattgcggcgttccgacaccatcaggtcgcccgtcgtgaacagcacttccaggtggcgcttctcgggcttgcgatcccaccagccgttgcccttcacgccatcctcgcggacgaaatccgccgacttcaccgggccttcttcacgaatccgcgcgagcagccgctcgatctcgggacgattctgttcatgccattcggccgcatatttccagcccatccccgacggatcgagcatcttgtagcgcatcaggccgaactgctcgaccggcaggaagcacgcttcgtgcgaccagtattcgaacaggcgcgcctcggcgagatgctcgtcgagccactgcggcgagaaatcgccgagacggctgaacagcacgagatacgggctgcgcgcgacgacgtggatggtatcgatctgcaactgcgccatccggcggatcgtgtcgagcacgtcggctttggtcgccttgcggcggggcggtgtcagcaggccctgcgcggcgagatgcagggcgcgggcggcggcgggcgagagcgtaagcatcggaggggcggccgggagtgatggtcgggaaccactttagcgcgaaagcggcgcgcgcgtgcgacgtgccgatgcaacgtgtctgacaatggttgacagatacgtttcgcaagtttccctatagtgcagtccatggcgcgacgaaatgtgcgcgcaacgattccgcttccgacgcacatatgtccatggcacgcaggaagcgaatccgggattctcaaccccatcgggagacccggagccctgagcggacatccatgcggctgtgcaccggccccgtgtggatgtccgctgatttttgtttttccggttttcgtccgttgccgcgcaggtcatgccgcggcgctcgtctctcgggccgcagcgcgcgggacaggtcgtagtgcttcgccgcgccgtaacgcggcgagccgaagtgccagtcgtagttgccgcgaatatacgagtgggcctcgtcgagcaggcgcagcgacgcgcgatcgtcggtgcgcgtacgcacctttttccagatcgagatagcgcgcgagatagccgttgtggatgtccgccgccgcgtcgagcgcggcttgcggcgcgagcccgtgttcgtgcatcaggacgcagacgagattgctgctcgattcgcccgcctccttcggatacgaaaagatgtcgttgcacaggcagaggatcaggccggacagcttgcgcaggcgctcgacttcttcgtcggcgtagaacgcggcgggcgcttcgtagccccggcgatgtcgatcagcgcgaacgcgccttcgccgcatccgttgtaggtgcgaccggagagatactcggcctcgccgggcacgacgtcggtcgcgaaccggccggcttcccacagcgtcgagaacaggaacgtcatcatccctgccacccagcgtgcgtactgcacgcgcgtggacgcggccgcgatgcgcgcgcacacgtcctgcgtcgcccgttgcagggcgggcaggaacgcggccatgtgcggcaggcgcgcggccagcgcggcgcgcagcggcgctggatcgtggccggtcggatcggcgatcatttcgtacagccacaggtagagtgcaccgaggtcgcccggagcgcgcgcgacgccgtgcaggctgcacaggccgtcgtcgatcgcgaagatccagccgtacgcgcgggtcgtcgtgcacaggccgtcgaaggttgcgtgcgcatagacgcgggagcagtattcgccgatcttgccgtgacggatgccgttggcccagcgcggatcgtcgagcaagccatggccgttcatccacgcgagcaggtcggcttcggcgcggtcggcgtcgggatgcacgggcgtgtcgaacgggtggaacaggtgcggaagcacgagtgcgggcgcggcggcttcggcggcaacggtttcgacggtggacatggcgtacctcgcggatggcgggtggcaacaggtgtcgtgaaggcagtccggcctacttgccgaaccggcgcgcgcgcttgccgtacgcatcgatggcctgttcgaaatcgtcgcgtccgaaatcgggccagcacgtcggcgtgaaatagaactcggagaaagcggtttgccacagcatgaaattcgacaggcgctgctcgcccgacgtgcggatcacgaggtccggctccggctggccggccgtgtagagccggctcgcgatcaactccgggctgagctgcgcgagcaactgatcgacggtgccggccgcgacgtgttccgcgatcagcgagcggacggcgtgcagcaggtcgaggcggccgctgtaggcgacggcgatgttcacgtcgagtccgtgcgcgtgggccgtgcgttgctgcgcggcgccgatgcggtcggccgtggcgggcggcaactgcgtcaggtcgccgatcacgtggagccgccagcggccgctggcggcgagctcgtcgaagacgtcggcgatcaccgcgagcaggccgcgcaattccgcagcgtcgcgctggagattttcggtggacagcggccacagtgtcacgaacgggatcccggcctcttcgcaccacgacagcagcgcatgcacgttgcgcccgccggcccgatagccgtcggcggccggcaggccgaggcggtccgcccagcgccggttgccgtcgagaatgacggcgagatgcgtgggcaatggcggccgggccgtatccgatacggcgggcgagtcgatggcgaatgtttccggcgcgcgcagaatcagctcttgagtcatggagactccttcgaggcgaggaagcgatcgaaacgtgaaacagcgggtgggatcgtcgtggcgactgctgcaatccggcgtggagatcatgttcgcgccaatgcgagcgatcattattgatcaatgaatttcggattttcaagtcattcgtatgcacgatatcggggcgcgccgatgcaagcgaccgcgccggcattacgcggcgccggcagatcccgggcgcgacgataggcagtcgattttcggcgcgatgccatttcgacgcacggattcaacgagcgcttttcgtgtgtttcgcacgattgaataaatcgtggaattggaaaataaaagcgatgcaatacgcgggcgctcgattgcggcggaaacgattccgccgcgtcggccgtcggttgcttattgccgcttgccgcgcgcgacttcgtcgccggcgccgggcggcagccgccgcgtgatcggaatcgatgcgaacgagcacagcccgaccacgacgaacgcgggccagaaatccgaccacaccatcttctgatgaccctgcagccagtgcgaaacgtgcagcacgaggccggccaccgtcacgccgagaccgagcgacatctgctgcacgacgctgccgaggctggtcgcgcggcccgcgtcgcgcggcgagatgtccgcatagatcatcgagttcaggctcgtgaactgcagcgcggggaagatgccgccgacgagcacgatcagccagatcgcccaggtcgccatgccgggatggaacacgccgtacgcggcgatcgcgagccccgcgaatgccgcgttgtagatcagtaccgtgcggaagccgaagcggcgcagcgtatgggtggccgtcgagcggctcatcgcgccgccgaacgcggacgcgcacgtgatgagccccgaatggaacgcgctcatgccgagcccttcctgcagcgcgagcggcagcaggaacggcaccgcgccgaggccgatgcggaacagcgacccgccgacgacgctcgcgtgatacgtcgggatcttgaggaagctgaggtcgagcaccgggcgttccttgcggcgcgcgtacggcacgtagagcgcgagcaggacggtgccggtcacgcacatggcgagggcgttcgagcgtgacgtgagtgcaccgtcgatcagcgtgaggcccatcagcagcagtgcggcgccgctggccgacagcaggaatccgaaccagtcgagcgggcccgggtcgggctcgtgcgtgttcgcgatgtgcttgctcgcgaggtagatcccgtagatgccgatcggcacgttgatgaagaagatcatccgccagtgcaggtaggtcgtgatgaagccgccgacgagcggcccgaccgtgggcccgaacagcgcgggaatcgcgaggtagttcatcgcgcgcacgagatcggagcgcggcactgcgcggaaaatgatgatgcggccgacgggcaccatcatcgcgccgccgacgccctggatgaagcgcgcgaacgtgagcacgccgagggaattggacgccgcgcacatcagcgagccgacgacgaagatgccgatcgcggtgcggaacacggagcgcgcgctgaagcggtcggccagccagccgcagatcggaatgaacacgccgagcccgaccacgtaggccgtgatcgcgatgttcaacgtgacggggttgtgcccgaagtccctcgccatcgcgggcagggcggtgacgatgatgttcgcgtcgacgctttccatgaacaacgcacaggcaacgatgagcggtgctagaaagacgggcgacatgggctgggcgcgcggtaaagacgccattatgcccacaatgtgaccgttgagtcacgtacgacaacagatgttccgcatattgcaacagtcgttcttttcgcgggcggcgcggaaagaacgactgcgcaaacgccgagcatgcctgcgcgagccgcgcgaatcgaaacttgcttgatgtgcacgttttgtgcgacagtcaggcccactcgcaacacaaaacgacgcgcatcgatcgagggccatcgagacgagcgcgcgcgcgaacgagacctcgtgccgacccgctcaccatcgaaaggaggggacacgtcatgacgtcacgtcgtgccgcatcgattgcatctcgcatctcaacgcgcatcccaacccgcgtctcaacccgctttccgctccgtcgctcaccgccgctcggacgccccgcgccgcgtcttcgctgggccgccgcgctggccgtcgcgtatctcgccgttgccggctgcgccgcgcaggccgacaacgcgaaccgggccgccgcgcaggcggtcgatcagtcggcggcgcctgcaacggccgcggttgccggccccgcgtccgcgtcgggcacgctgctgccgccgccgagccagctctacggcgacctgttcgtcgcggtgcagaccgcgcagatctatcccgaccagaagaccttcgtcgacgcgacgcccgacagcgatcccgcgacgatcgtgcagttgtatcagcaacagaaatcgcagccgggcttctcgctgaaggcgttcgtcggccagcatttcacgccgccccggaaggcggcgtcacgccgccgccgaaccagacgctgcgccagcacatcgactggctgtggccgcagctcacgcgcacgagcacgacggtgccgccctacagttcgctgattccgctgccgaagccgtatgtcgtgccgggcggccgcttccgcgaaggttactactgggatacctatttcacgatgctcgggctgcaggtgtcgggccgcgaggatctcgtcgacgacatgctcgacaacttcgcccatctgatcgacacgatcgggcacatcccgaacggcaaccgcacgtactacgcgagccgctcgcagccgccgttcttcgcctatatggtcacgcttgccgcacaggccgaaggcgacaaggtctaccagaaatatctgccggaactgcgcaaggagtacgcgtactggatgcagggcgaaaccacgacgccgcgcgggcaggccgcgcgcaatgtggtcgcgatgcccgacggcgcggtgctgaaccgctactgggatgcgagcgatacgccgcgcgacgagtcgtatctcgaggacgtgacgaccgcgaagtcggcgccggggcgtccggcgaacgaggtgtaccgcgacctgcgcgcgggcgccgaaagcggctgggactacagctcgcgctggttcggcgacggcaagacgctcgcgacgatccgtacgacgtcgatcgtgccggtcgacctgaacagcctgatgttccatctcgagacgacgatcgtgaagggctgcgcgctcacgcgcgacgtggcctgcgtgaccgatttttccgggcgcgcggcgcggcgtgcggccgcgatcaaccgctatctgtggaaccgtcgcggctactacggcgactacgactggcagttgcgcaagccgcgcgacgccgtgacggccgccgcgctgtatccgttgttcgcgggcgttgcgtggcccgagcgcgcgaaggcgaccgcgcgcgaggtgcgcaagacgctgctgcagccgggcggcctcgcgacgaccaccgagaacacggggcagcagtgggacgcgccgaacggctgggcgccgttgcagtggatcgcgatcgacgggctgcggcgctacggcgaaccggcgctcgcgaaggacatcggcacgcgtttcctgtccgacgtgaagcacgtgtatgcgaccgaaggcaagctcgtcgagaaatacgtggtcgaaggcgccggcacgggcggcggcgggggcggcgaatatccgctgcaggacggcttcggctggaccaacggcgtcacgctgaaactgctcgggctgtacggcgagtgacgcgcggcacgggccgcgcgcttgccccgcgagagaacgcacgggccggactgtcgcgtaagcggccgaccggcccgtgtctgcatccggcgtgcgtcagaacacgatcgtcgtgcgcacgccgaccaccgtttcgtccccgatgcgcgcaccggccgtgttcgggttcgggatgccgccgcccggacggaagaagtgctgcaggtcggcctgcaattgccaccacggcgtgacctggtactggtaggtcgcctcgacgaccgtctctgcgcggcgtaccggatagccgggtgtcgtgtacgcgccggtgtcgccgtcgaggccgcgcgcatgcgagccgatcttcgtgtagccgaccgcgagacccgcgacgtcgttgtcgcgtcccttgaacggcgccttcagcgtcacgcctgcattggcggcgaaatcgacggtattgcgatcgcccggcgcgcccatcacgcgcgcgaacacgcccaccgagcgcgggctgtccggcgccggccgccacaccatctggtccgcgaccgcatagaaactgtagttgccgcgatgcgtggccggcatgccgttgctcgccggattcgcgagcgacaggccgtcggtgccgtagcgcggatcgttcgcatgctgcgactgataccagaagccgagcttgtacgtgcccggcaggccggccggctgcggcgccttcggatcggcgggcggcgcgttcagcgcatactgcacttcgccgatcacgaacgcgccgctgcgcaggttgaagtgggtgccgtgcgcgttcagcacctgcgcatcgccgtcggtgcggccggccgggttgccgtcgaacacgccgaccattgcggtccacgcatcggcgggcttcacgcgcagccgcacaccgagcgacgacatcggatacgcggggccgccggccgggagatcggtcgacggcagcacgggccagccgaacgtggcgttcatgaaggccgacgcgttctggctcaccatgaattcctggtcgacgctctgctggccgaccttcacgtcgaccttgtcgtcgagcagcgactgctggtaccagagctcccataggcgcgtggtcgaattcgcctcgatgccggtcgcggtctgcagcgtctgcagatagcgctgcgtgaggttggtgccgtgaatctgcagcgccgacacgttgaacgtgccgcccggcaggccgaccgccttgccggtgtcgacgtcgaagccgaattgcgtgagcccctggtaggcgccgccgcgacccgtgccgcccgacgtgttgtacaggtactcgctggtctcctgcaggttcagcgtgatgccgtgatcgcccagcacgtcgcgcaggccgcccatgttgccgagcaggttcgagcgctcccggaagccggtgggcgcggcggcgtcgccggcgccggccgccggttcggccgaggcgggcagcgaagattgcgcgaacgcgggtgcggcggcgagcgacagcagcagcgcggcgagcgcatcgaggcggagcgtgcgcggaacgtgttcgagagggttcttcatgtgggctccgttggtggtttgattagtgaggctgaagaagcgaaaacgtgatgcgggaagcgtggcgggactgtcgcgcagcacggctgcgcgacggacgatttacggcagccagccgccgatacgccacacctgcgcgaagccgaggcgcggcgcggccgagcacagcagcgcgacgagcgcgaccgcggccgccatcacggcgaacagcaggcagtcgagcgggcggggtgctgccggcacgtgggcgagcgccgagctgcgccagttgccgagcgcatgggcgagcggcgagaggccggaaacgaacgagcggtcgcgtgcgacatgcacaatgtgcttgagcctgaccgcgagcgattgaagaaacatgacgctgcctccgtccggtccggcgaaggccggacgacgtgatcgagcgcgggcgcgtgacgcggccagcgatcggagggtggaacgtaacggagcgtgcaacggacgaaccggcgatggccggcccggaaggaagcgcgctaacccgacgaatgcgagctagcggcgtaagacatgcgtctggctgctatctcgcgatggcttggccggcctggaccggcgtcgaactgcaactagagcatgtgtccacggagggactcctgtgatgaattgcggcggattgtattcgcgtcgtttgctgcagtaaaaaaacgcatgaaaggcgccgtgcgtggcggatgcatcgccgtggagcgcgagggtgcgaggccgccacgacgaggcgacggccgggtgccgcgccgttgttcgcacacatcggatggtgaccgcgacgtgacgcgctgaaaggtttcggcacgtcgtttcaagggcaattctttcagtgccgagaaggcggaaatttatttcgggaaatggggtttggcggggttgacttcactttcgggccgtccatagaatccggcatcttcactcttggggccgccgccttggacgcctgcagtagtcgatcttcgaacgaaatttccgcctgagcgaccgacgtccgcgcctcatcgaagccgccgtttgtccccgggcaaacggtgcgcgcagcagtattccgcagcaaattcctacgtgcaccctgattcgcgccggttagcgtgatgcgttttcgcatgcgccgcccggtttcaccgccgcccggcaggcggccgcgttcgcgcacgcctttccccggcgcgcgaatgccggcccgcacgtctgacggcggtcaaccgtgttctccggaacaccgcacaggagccgccatgaacgacagtgacagttgtcccttatgcccgttgcacgcacagacccttttgaacccgggtcgcagggacaatccggccgactagcctgacacgccgttcaggcgccggactggccccgcgcccaccacgcggccggcacgcttgccgtcgccgcacggagccagaccatgaacttcggccttctgctgtcgaatctcccgcacgtcacggaatcgcgcaaccactacgacgcgatgctgatgctcgacgcccgtccgcgggtgttctcccgcctgttgaaccggctgaaatcgctgatccgctgaaaaagcgccgagcgcgcctcggcatgcgcacgcgcggccgccatcgggcggtcgccccgcgcgcatcccaaggtcgcacgctcaccagataaccattagccgtacggaacacatcatgtccacgccatccaacgtttctccaccgatcgccgtcgaacgcgccgccgtgctcgacgaggcccaccttggcgacatccgcggcgcgctcggtacgatcgcgcatcacgacaccggcacgcgcggctcgtggtgggcgcgtctgcgcacgctgctcgcgatcatcggcccgggcctcatcgtgatggtgggcgacaacgacgccggcgcattcggtacctacacgcaggccggccagaactacggcacgacgctgctgtggacgctgctgctgctcgtgcccgtgctctacgtgaaccaggaaatggtgctgcgcctcggcgcggtgacgggtgtcggccacgcacggctgatcttcgagcgcttcggcaagttctggggcgcgttcagcgtgatcgacctgttcctgctcaatgcgctcaccatcgtcaccgagttcatcggtatcacgttcgtgctggatttcttcgggctgccgaaggtcgcgggcgtgtgcgtggctgcggcgctgaccatggccgcggtgagtaccggggatttcaggcgattcgagcggttcgcgatcgggctgtgcgtgctgagcctgctgctcgtgccggtgctcgtgtcgatccatccgcccgtcgcgcagatgacgcgcgatttcttcgtgccgaactggcccgcgcacgcgaagctgtcggacgtgatgctgctcgtgatcggcatcgtcggcacgaccgtcgcgccgtggcagctgttcttccagcagagctacgtgatcgacaagcgcatcacgccgcgcttcatgaagtatgaaaaggccgacctgtggatcggcatcgcgttcgtgctgatcggtgcggtcgccatgatcggtttcagcgccgcgctgttcaacgggcatccggaagccggcaacttcgccgacgcgggcggcatcatcgcgggcctcgagaagtatgccggccgcacgagcgcaacgctgttcgcggtggcgctgctcgacgcgtgcatcatcggcgcggcggccgtgtcgctgtcgacggcctatgcgatcggcgacgtgttcaagatccgccactcgctgcaccgcggcgtgtccgatgcgaagggcttctatctcgtgtatttcggcatcgtcgcggccgcggccacgctcgtgctgattccgggcagcccgctcggcctgctgaccgaagcggtgcagacgctcgcgggcgtgctgctgccgagcgcgacggtgttcctgctggtgctgtgcaacgaccgccaggtgctcggcccatgggtcaactcgacgaagctcaacgtgttcaccggtgcggtgatctgggtgctcgtgctgctgtcgatcatcctcactgcgtcggtgatgtatccggatatcagcggcgaagcgatcgtcgacgtgctggtcggcggcaccgtgctcgcgatcacgggctacatcgcgacggtattgatccgtcgcaacaagcgcgtgatcgaaccggcgatcgatcgcacgttgcgcgacacgtggcgcatgccgccgctcgatacgctcgagccgcagaacatgacgctggcgacgcgaatctggatggccgtgctgcgcggctatctcgtgatcgcggtcggtctcgtgatcgtcaaggtggtgcagatgacgctgctgaagtaacgcaggccgtattccaggaagcggcgccgggccgcagcccgcacatgccggcctccgtggccggcatgtgcgtttacgcgcccgcttgcggcacgtcgcatgcgctgcgcgacggtcagatcaattcgagcttcgacgtcaggtacgtgagctggatgcggttcgcgacgccgaagcgcttgcgcagcttgcgcaggtgatagtcgacgttgtgcgcgctggtgtcgaggcgccggccgatctccttgtcggatgcgccttcggcgatgccgatcagcagttcctgctcgaacggcgtgagcccgttcaccgcgcgctcgcgcgatgtcgagatcagctgcggcgatgcgaacttgtgcaccgacagcccgatcgacagcgcctgctcgatcgtcgccggcgtgatccattcgcgcgtgcggcgcggcgcggtgaagctcatgaacgcatgcagccgcgtgccgggcacggccatcgaatacatgatgccgctgcacatcccgtcgtcctgcatcgtctgcaggaagccgtcgagcgcggccggcgtcgcgcgcgggccggtgtcgcgctcgcggtgttcgcggcgcaactgctgcaggtcccacacgatcggcatgttgcacacgcgtgcgccgagcgtgcgcggatcgacgtcgtgatggtggtggcgcacgtagtcgccgcggtaggtggacggcgtgaatgcttcgtgcaggtagagactttcgacccgctcgtgcgcgaattcgagcgcgaagtacgcgaacgtcgagaaacccgtcaggtgcagcaggcttgcgacgatccggctgcgctcggccgtgctctgcgcgtgcgcgagcgtatcggccacgccgagtttcggcgcgtgcggctgcgtgacgtcgccgcgcttcacgtcgtcgcaccagatgacctgcacggggcgctcccgcggcgcgtcggggcacgcgctcagcccgtgcgacgggcggggaaaggttgaggcgaccgcttcttcatgcaatgcaatgtcggacatgtgccatcctcggaatcgacgcatctcgcctgacggcggccgtatcgtgtacggccgtcgcggcggtgcgatcgagcatcggtgtgatatgcgcggatcgtcatccatgacgcagcgcgggggcattgtacaaaaacgcttgtgtacgcgtaatatgccgtaatactaatggcggcggaagattcctattcgcacgcaaataacgaagaccagaaaatccatcgagacaagaccagatcgtgacggggcgcaggttcacatattgggaaagggcgggctcctcatgacatacgctgacggcgcaccacgcgtcgaatggttttcgcaggccgatatcgcaacggccgcggcttattcgaatgaatatcaggcaatcgggcacgacgtttttaccggcgcgcaaatcgaattcggtaaaaccgacccggctttggtcgatttcgcgcagtgccatgcgcgcttgcggcaaatcggtttcagtacgctcggttacggcgctttcgaaatgatcgggcggcgcatcctgtgtgcgcacctgcttcgcgacctcgctcccgcgacgttcatgcagccgtttttcgagggcatgctctacgagagcgacccgcggttcgcgcaggtgcggcagagcggctttccggtcgcgtggcagctcgacgagatcgaggcggccgcgcagggcagcggcgaccgcaagatgctggcgctcgccggccatctgcgtgcgcacgcgatgaacagcggcgtactgttcggcctgtcggcgccgcgcctcgacctgcgtgtcgcggtgaacgtgacgtcggagacgcacggcaccgaatggatcgacgatcgcgtgatcggcggcgcgctgtcggtcagcctcgcggtgcatcgtgtcgcgctgccgttcctcgagtcacgcatcgcgcgcatgcgcggcttcgcgctcggcgacgagcaactacaggtgctcgaccgcctcgtgcacggtctgtccgaccaggagatcgcgagtgcgctgcgcacgtcgctgcacaaggtcggccaccatatccgctcgctcgaaaaactcttcaacgtgcagaaccgcgcgcagctcgcatatctggcggcccgccggctgccgtcctgaccccgcgcgtccgccgcgttcgtccccgttttaccccgcgatcgatgaccgtcgagccggcccgtgcgtggccagcccgacgggttgctgcggccgcgcgcgccggcgcgccgcgcacacgatgcttgacagcggtttttcgagtgattggcgagttcacctatgaattattgctgatttatttcttcgtaatatggcccggtcgtcacgccggatggcgggccgcgaggttgcgccgtgcgtgacggaactggtcaacaggggcagacaaatcaatgtgcggaatcgacggctttttgaatagcgtcgcctgcgatgaggagacagcgcgcggcacgctcgcgcgcatgacggcgagccttgcgcatcgcgggccggacgggcaggggatctgggtcgacccggaggccggcatcgcgctcggccaccgacggctcgcgatcgtcgacctgtcggtacacggccgacagccgatggcatccgcgtgcggtcgctacgtcatggtcttcaacggcgaaatctacaaccatcgcgaactgcgcgcggagctcgagcgcgcggggcgcgcaccggcgtggcgcggccactccgacagcgaggtgctgatcgcggcgatcgtcgcgtggggtgtcgacgcgacgctgcggcgcgcgaccggcatgtttgcgttcgcgctgtggaatcgggcatcgcgggtgctgacgctcgcgcgcgaccggatcggcgaaaaaccgctctactacggtcggatcggcgacgcgctcgtgttcgcgtccgaactgaaggcgctgcgcggctatccgggcttcgacggcgcgatcgatcgcgatgcgctgtgcctgtacctgcgccagtcgagcgtgcccgcgccgcatacgatctatcgcggcatccacaagctgccgcccggcacgtatatccagttcgagcatgcgcgcgacacgccgcgcctgcgtgcgtactggacgctcgaacaggtgatcgaggacggtcgcgcggagccgttcgagggcagtgccgacgacgcggtgggccagctcgacgtggtcctgcgccaggccgtcgcgcggcagatggaagccgacgtgccgctcggcgcgttcctgtccggcggcatcgattcatcgacgatcgtcgcgctgatgcaggcgcaatcgtcgataccggtcgatacgttcacgatcggcttccatgaggccggctacgacgaggccggttatgcgaaggccgtcgcgcgccatctcggcacgcgccataccgagctctacgtcacggccgaccacgcgctcggcgtcgtgccgaagctgccgtcgatctacgacgagccgttttccgatgcatcgcagattccgacctttctcgtgtcggaactgacgcgccggcacgtgaaggtgagcctgtccggcgacggcggcgacgagctgttcggcggctacacgcgctacttcctgacgccgcgcctgtggcgcaagctgcatcgcgtgccgggcgccgtgcgcgcgcggatcgccgccgcgctgcatgcgttgcggcccgatcacgcggatcagcttgcggccgtcgcgcagggggcgtggggcggcgtggatgcacgtgaatcggcggcgcgcatcggcgatcgcctgcacaagctcggccatgtgatgaccgccgagagccgcatcgggctgtaccggctgctgatgtcgtcggtgcatcatcccgagcgcctcgcgctgtcggggcaggagccggcgacgccgctcgacaccgtatccgcatggcccgcgcacctgagcttcgccgagcaggcgatggcgatcgacacgctcacgtacctgccgaccgacatcctcgcgaaagtcgatcgcgcggcgatggcggtgagcctcgaaacgcgcatgccgttcctcgaccatcacgtcgtcgaattcgcgtggcgcgtgccggcgcacgtgcgcttgccggaagggcaatcgaaggcgctgctgcgccggctgctcgaccgctacgtgccgtccgcgctgatcgaccggccgaagcagggtttctgcgcgcccgtcgatcactggctgcgcggcgcgctgcgcgactgggccgaggcgctgctgcggccgtcgcggttgcgcgaggaaggctatttcgatgcggacgcggtcgaacgtctgtggcggcagcacgtgaccggccggatgaactggcagcaccagctgtggacggtgctgatgttccaggcgtggctggaggcgcaacgcgccgcatgaggcggcgcgctgcgcgtcgttactgatcgaggcagcccatgcagcgccgcttcgcgtcgttcgagtggaggccgcgacacatcgtcatcacgggccgcgcatggcacgaaggcggatcggcggaggccgccggcgaagcttgccggcgcgcgcgatcgggcggggtggtcgcagcggcatccatccgtcgctggcgtgcgggcggcgtgtcgcgaccggcgctgccgtcatccggatcgcccggcgtcatcgacgcgacgtgaagcgtggtgtcgttcgccgcgtgcgcaacgggcggcgcggtgcacacgagtgcggccaacgtgcaaaggcaggcgacggcagttcgcgaatcgcgcatcttcatgatcgttccgttcgttccggggccggcggcgcggagggcgcgcggctaccgggtcgattgtagggacggcgatggtcgcgtgtcacgccggattccgtagtcgcgggcatcggcggcggcccgagtggacgcgacgacgcgtgacgaagcgtgatgtcgtgcggccgccggcacccaaagcgaccgccgcccggaggcggcggtcgggtcgcgactggctggcgggccgggcggcgtgcgggccgcgcccgacgggcgtgccgcgaagcgctgcggatcggcgcagcgcggtggggagctcgcaggcgagccgcatgcatgcggctcgcgggtaaatcgtcaggcgtagtcggcggccatcacggcttgcggtgccgcgcgcaggatcggcgcggcttcgtggcgctcgacgtgcgtcatcgccgcaccgaacagcaccaggcgatagccgaccgcatagatcggaatgatccgcaggttcttgtcgtgatcgagttgcagcttcgagcggatacgcgagatatgggtgtcgagcgtgcgcgacgacacgccgagttcacggccccacacggcttcctggattgcctgccgcggcacgatcttgttcatgttgtcgagcaggaattcgacgacgtcgaattcacgcggcgtgacgtcgacgatcttgttgtcgatttcgatcgtgcggcgcacgaagttgatttttatgttgtcgatgtacaggtatttgcaatccatggtggccctcgcatgtccataaaggagtgtttgcgggtcctgtgctgcaacttccgggccagggaagggatcgtcacgtcacgacaggggcggcacccgagcggacggcgctgtagccttgaatttaaaagaattttcaaggagtggcgtgccgcgggtagggaaagggtccgagcaaaggtgaaggattgttacgtagcatcggcggctgacgttacgggcgttacgtctgacgtaacgcgggggcgcagggcaacatgcgcgcgatccggatcggcggcaggggatgggaacacgacatcgaaccctacatcgaaccctacatggttcgatgggaaatccatataaatcagtgacataagtggccacacttgccgacatcgaaccctacatgaaaccctgcacggaagcatgacgaccgtcgccacctttgaaccgttgtttcccgaagatcgcgtacacgatccgctgctcgagcaggccgccgaactcgtcgattcgtcgcagcggttgcttgccgtacgcgataccccgctggcgactgcgctctgctgacttcgccttcgcatcgtggtgaactttcgttcggattgccgctgagcagcctccggtttctgtttccgaggctttggccggaagtcgagcaggagtaagagggccgacgggccgcgcgacgtcgggcggcgtcggctcgaaccagcacgacattcccgcgatgcattaaaaacgccggccgcagggcgtctccgcccgcggccggcgtgtcgccccgccgtcaagccttcgcgctatccgccgaatcgaacggcagcacgtaatgccgcttgcccgttgccgcgaagatcgcgttcgcgaccgcgggcccgaccggcgcgacgcccggctcaccgaccccggtcggtgcttcggccgacggcacgatatgcacctcgaccttcggcatctccgcgatgcgcagcacgtggtagccgtcgaagttgcgctgttcgacctggccgtccttcagcgtgatcgcgctgtgcatcaccgcgccgagcccgaagccgatgccgccctccatctgcgcggcgacgatgtcgggattgatcgcgatcccgcaatcgaccgcgcacaccacgcgctcgaccttcaccttgccgtccgcgtcgaccgacacctcggccacctgcgcgacatagctcttgaatgcctcggcgacggcgatcccgcgcccgcggcccttcggcagcggcttggccggatcccagccggccttctgcgcggccaggtccagcaccgcgcgcatgcgcggctccttcgcgagcaggtcgcggcggaatgcgtacggatccttgcccgccgtgtgcgcggcttcgtcgatgaacgcctcgacggcatacgcggtgtgcgagctgccgaccacgcgccaccacagcacgggcaggcccaccttggtggtggtgagttcgaccgacacgttcggcaccgcatacggcaggttcgccgcgccctcgaccgaggtggcgtcgatgccgttcttgaccatgaacgcttcgaacggcgtgccggcgagaatcgactggccgacgatccggtggcgccagccgaccagcttgccgtccgcggtcagccccgcgtcgagcttgtggaagtacatcggccggtagaagccgccctggatgtcgtcctcgcgcgtccattgcagcttgacgggcttgccgtcagcgccgagcgccttcgcgatcgacacggcctcgaccacgtagtcggaccacgcgttcgcgcgccggccgaagctgccgcccgcgtacagcgtgtggatctgcacctgttcgggcttcaggccggccgtcctggccgcgttggcctggtcgaccgtctggaactggtcgccggcccagatttcacagctgtccgccgtcagcttgacgaccgcgtcgagcggctccatcggcgcgtgcgcgagatacgggaattcgtacgtcgcgccgatcttgcgcgcggcgcccgcgatcgccgcatcggcatcgccgtccttgcgtgccgacgtgcccggcttgtcggcgagctgccggtattcgcgcatgatctcgtccgagctgcgcttttcggcgtgtgcttcgtcccattcgaccttcagcgcgtcgcgaccctgtttcgcggcccagaagccggttccgacgaccgcgacgccgcccggcacctgcacgaccgacacgacacccggcacggccttggcggccgtcgcgtcgaacgatttcaccgtggcgccgaagcgcggcgggcgctgcagcgcgacccgcatgccggggaaggtcgtgtcgagcgtgaaatgcgcggtgccgttcgatttcggcgacgcgtccacgcgcggaatccgctggccgatcagcttgaaatcggccggctgtttcagcacgaccttgtccggcaccggcagcttcgatgcatcggcgacgagcgtgccgtacgcggccttcttgccgctcttcgcgtgcgtgacgacgccgttggcggtcgtcagctcgccggccggaaccttccagcgggccgccgcggccgacaccagcatcgcgcgggccttgccgcccgcttcacgcagttgctgccacgagttcgccatcgccgagctgccgcccgtgccctgcatcgtgccgaacgcgaggttcgcgtagcgtttcgcatcggccggcgcgctttcgacgcgcacggtcgaccagtcggcgtcgagctcctcggcgacgatcgtcgcgatgcccgtatacgcaccctggcccatttcgacgtgcttcgcgatgaccgtgacggcgccgtcgggcgtgatgcgcaggaacgcattcggcgcgaagtccgcggcgggcgcggtcgcggccagcgcgcggcggccgaggccggcccattcgaagccgatggtcaggctgacggcggccgcggcacccgcggccttcaggaacgtgcggcgcgacggacgcaccgacccggtgttgtcgagttcgatcgtcatggtcaggctcccagcgtcgcggccgcgtcgtggatcgccgcccggatgcgggcgtaggtcgcacagcggcacaggttgccgttcatcgcggcgtcgatgtccgcgtcggtcggcttcgggttctgttcgagcagcgcggtggccgacatgatctggccggactggcagtagccgcactgcggcacctgcagcttgacccaggcggcctgcacggcctgcgcgggcttgctctgcagtccttcgatcgtcgtgatgtgcttgcccgcgatgccggcgagcggcagcacgcacgagcggacggcctggccttcgagatgcacggtgcacgcgccgcactgcgccatgccgcagccgaacttcgtgccggtcagtcccgcgtgttcgcgaatcgcccagaggacgggcatcgacggatcggcgtcgagcgtgacgttcttgccgttcaggacaaaggaggtaggcattttgattgtctccgtggggaaaacccggcatgcgcccggttagcgggcagtgtgcgcgaggcaccggcttttgcgtctacccaatcctgcaaatttattgaacaatcctgcaaatccccggcaggctccgggcggtttcgttatgctcccgcgacatgaggaaatctatcgaggaagtgtcatggacatgaccgatatcgtgacgtcgcgcgaatccgggcggcgcgagctggcgacgctgatcggccgtttcgcgccggcggacggctcgcattcgacggccgtgccgggcctgatgctgcaccggcactcgcggccggtcgatctcggctgcggcgtgtcgcgggccgcgctcgtgatcgccgcgcagggcgcgaagcgcgtgatcgtcgccggccaggcttacgagtacgacacgcagaattgcctgattacatcgatcgacttgccgatcctgtcgcgcgtgacgcacgcgtcgccggaagcgccctacctgtgcctgtcgctgacgctcgatccgcagcgcatcgtcgagctcgcggccgagatgcggctgcccgaacccgacgcgggccccgaaggcgagggatcgcgctcgccgagctcacgccgccgctgctcgatgccgcgctgcgcctgacgcggctgctcgatacgccggccgacattccggtcgtcgcgccgttgatcgaaaaggaactgctgtaccggctgatgacgagcgggcagggcacgcggctgcggcacatggcgatcgcgggcagccagacgcaccggatcgcgcgcgcgatcgaatggctccgcgatcacttcgcggagccgatgcgcgtcgagtcgctcgcgcaggcggtcaacatgagcgtgtcgtcgctgcaccaccatttcaagcacgtgacgacgctgagcccgctgcagtaccagaagcagctgcggctgcacgaggcgcggcggctgttgctgcggcagggcggcgatgtcgggtcggtggcggccgtcgtcggctacgaaagcgcgtcgcagttcagccgcgaatacagccggctgttcggcgcgccgccgatgcgcgacgtcgtgcaactgcggaagaaggaactgctcggctgacggccggcagccggcgcgcggccggttgccggtcgccggtcatttcatcgggcaaccaccgtcatctgcaggaacgtcggcgcgatccgccagtccggcacgtaatgcgccggccacgcgcccggcgtatcgaccgcgttgaaatacacgaccgccttcagcagcggatagcgccacagcgaccgctggagttcgtcgagggcctcgcgcttgcgcgaaccggacccgtcgacgccgagctccgtgatcatcaccggcagcccgtaatcggtcacccgctcgtatttggtccgcaggatgctcgcggcggacgcatggccgccggccggccagatcgcgcagcgcgggcagtcgaacacggacaggccgacggcgtccacataaccgcggcccggaaaatagtcgtcgaggttccggttgccggccggcgaccacacgaagcggagctggtcggtcatcgtgcggcacgtggtcacgacgcgccggtacgcctccacgtaggccggcgcatcgccgatggcccacgggtagcgcccggtgtcggcctccatctcgtggccccagcgcacgaacacggggcccttcaacgcggcgagcgccgagcaggtggccgcgatccgcgtgtcgtagcgcccgagcgcgatatccgcgagcagcgcgcctgggcgcgtgtcgcccgccgcccagggctcgacggtcagcatcagcgagcggttccgtgcctgggcgctccggtaggctgcatcgatttccgcgcggatgtcgggcgcgttccacgacacgaacacatggtcgaacgcgagatcccggttggccgcgagcgcgttgtcgggatcgtatgcgccgagttcgggctgcttcaccggttcgcccggcgcgggcgcgaccacggccggcaggcccgagcgccacatcatcgcctgccagcctttcggcgcgcgcagcccgatgcccgcgagcagcatcgcgagcgcgaacacgaacagcgcgttgcgcacgggcaggcggctgaagaacatctgccggaacgccgaccattcgagcccttgctccctgccgtgattcaccgcgacgacggccgcgatcacgagatacaggatgctcgtcagcgtcgagaacagatagaagcccgcggcattgcgcgggttctcgaccgtgacgacgggcaggctgcagaacagcgagatcagcaggtacggcgcgaccacgcgcagcggcgcgtcctgttcgatcgtgccgcccttcggcgtgaccttgaacggaaattccttgccgcgcacgaagtcgaacaccgccgacgcgcagccgagcacgacccacggccagcgcgcgaacacgaacgacagcccttcccacgacagcagcttcgtattcagcgggcggcacgactgggtcgaatgcgtggcccaggtcacgacgcacaggagcagcacggccagcggcagcgcgtaggtgaggtacgtgaggtagtcgacgtgcgcccacacgcggccggtgagcagcgcgacgaccggaatcacgacgctgccggccatcgcgagcgcgcacagcgggtaccacagctggcagaacaggaactgcgccttcagcttcagcggcagccccatgaaatagtggcgcgtgtagcgcagcatgatgatcatcacgctcttggaccactggaactcctgcgtggcgaggtcgccgaacgtgcgcggcccttcgccgttcgcgatcgcgttcagcgcgtgcatgccgcgccagcccttcgaattgaagatcatcgtggtcgagtgatcctcggcgagctcgggcccgagcccgccgatctcgcgcagcgcacggcagcgcaccgcatagtgcgagccgatgcacagcggcgcgaggccgcccgcataaccggcctgcatcgtgccgtgcagcggccctcgacgttcacgcgcccgcgcgcactccagcttccggccgcgttgctgtcgcagatgctcggtgccgacacgtagcctactttcggatcgacgaacggccgcagcatctcctcgagataggtgcgggtcggcacgtggtcggcgtcgagctgcgacacgaaatcgtagttgtcgtagccgaccatgtcgtagaagtacgcgagattgccttccttgcatctggtgcggcgcggccagcttgcgcggtggtacgcggcgatgccgcgccgcgtcgacacgaatacgccgcgctcgcggcaccagtcgagcgtctcgggcgacgggtcttcatcggcgagccacgtatcgtgcgggtaggtctggtcgagcatcgcgagcagcgtcgtgcggacgatgtcgaacggctccgacggcgccttggtgacgaccatcgcgacgcgccagtcgcgcggcaccggcagcgcggggttcggcacgaccgccgagcggatgatgaagatgaagtagcccggaatgaaggtggtccagaacagcacgaagcagttgacgccgaagcggaatgcgtcgacgtagtgctcgtcgcgcagccaccagcgccagaagatgcccagcgcgacgaaccagcacagcgcgaggatgtggaagacgatcctggtcccgctgtccatcaacgggacgacgagcgggacgtctgcctgctgcgagtcggtgcgaacggcttcggtgtcggtttcggcggtatcggcggtatccggcacggagccgcccgcaagcgacgcaaccagcttcttcatggtgctctcccgtcaaggtcagatcatcagtcttgaagcaggccgcgttgcggccgggtgtcctcgctggcgtgctgttgttccggtgccggggccgccggcgtgcgctcgccgcacgagcggcccacgcgttcgtagcggcgaaagccgctgtcgacggccagccgttcgctgaacaggttgcgcatgtcgagcatcacggggtcggccatgtgatccgcgaggtcggcgagatcgagtgcctcgaacgccttccattcggtcatcacgacgacggcgtccgcgctgcgcaccgcgtcgatcgcggaaccctccatgaatacctgcggcagcagccgcgacgcttcgtgcggacgtgccgggtcgtacgcgcggatatgcgcgcccgcgccgacgagcagctggatcacgtcgatgctcgggctttcgcgcacgtcgtcggtctggcctttgaacgtgaggccgagcaccgcgatgcgcttgtcctgatcgagccgccgcaggccttctcgatgcggcgcaggatctgctccttgcgcagcgcgttcgattcgatcgccgcgctgacgatgcgcagcggcaccgcgtgttcggaggccgtcgccttcagcgcgcgcgtgtccttcggaaagcacgagccgccccagccggggccggccttcaggaacgatgcgccgatgcggcggtcgaggcccattccgttcgcgaccagttcgacatcggcgccgaccgcttcgcacaggtccgagatctcgttgatgtagctgatcttcaccgcgaggaacgcattcgccgcgtatttcacgagttcggccgtttcgatctcggtcgcgagcacgaggtggcccgtcgcttcgagcggcgcatagatggccttcatggtctcgatcgcgcgcggatgctcggcgccgaacacgacgcggtccggatgcatgaaatcgtcgatcgccgagccttcgcgcaggaattccggattcgatgcgattgccgcgtcgacgcctgccggcgcgtggcgttcgacgatctgcttgacgacccggttggtgccgaccggcaccgtcgacttcgtgacgacgaccgcgaaaccggtcaggttcgacgcgatctcgcgtgcggctgcctcgacgtacttcaggtccgcctggtcggtgcccggcagcgtcggcgtgccgaccgcgatgaataccgcgtcgcgatcgcgcacgctcgccgcgaggtcgctgctgaagcgaagcgtgccgcgttcgacgttgcgtgcgacgagtgcgtcgaggcccggttcgtagatcgggatgcggccttcgttcagcgcgtcgatcttgccgcgattgttgtcgatgcagacgacgtcatgcccgagatccgcaaagcacgcgccgctcaccagcccgacgtaaccggtgccaacgatggcgatccgcacattcatggtgattcccctgggtggcgttcaaggaaacttgctcacttgccggattcgacttgcagtgctttctgaaaccatgccgcggcgtgttcgaccatcggttcgatcgcggtgaaacgcggccgccagccgagcacgagcgcggctttcgtggcgtcggcgtacagctcgggcgggtcgcccgggcggcgcgcggccgtcaccgtcggcacgcggcggcccgtcacggcttcgacggcgcgcagcgcgtcgagcaccgacgtccctttgccggtgccgagattcaatgcgacgctgtggccgccgccgcacagataggcggtcgcctgcaggtgcgcgtcggcgaggtcgctcacgtgcacgtagtcgcgaatcgccgagccgtcgggcgtcgggtagtcggtgcccatcacctggaacgcgtcgcccgtgccgagtgccgcgcggatcgcgagcggcagcgcgtgcgtttccggttcgtggcattcgccgatcatgccgtcagggtccgcgcctgccgcgttgaagtagcgcagcgcgaccacctggttccgtacgcgcgctcgaaatcggcggccatccgttccatcgcgtacttggtgaagccgtacggattgatcggccgctgcggcgtgcgttccgagatcggcagcgcatccggaatgccgtacgtcgcgcacgacgacgacatcacgatccgtccgacgccggccgcgcgcatcgcgctcagcagcatgcaggtgcccgtgacgttgaccgtgtaatagcgctcgggcgcgagcaccgattcgccgacgtaggcgagcgcggcgaaatggatcacgacgtcgggccgatgcacggcgaatgccttcgacagcgcgtcgcgatcgagaatgtcggccgcgacgagcggcccccaccgaacggcgtcgcgatggccggtcgacagattgtcgtaggcgaccggctcgtgtcccgcggccgcgagcgccttgcaggtatggctgccgatatagcccgctccgcctgtcacgagcaccttcatgccgtggccccggtcatgcacagcaccggctcgagccacagttcccggctgaaatagtcgacggtccggcgcagcccttcgtcgagatcgacggccggccgccagccgagctcggccgccgcgatcgagatgtcgggcctgcgctggtgcggatcgtcgatcggcagcggccggaacaggatctccgatttcgagcccgtcatcgcgagcactttctccgcgagttcgagcatcgtgaattcgccggggttgccgatgttgaccggcgtgccgatgttgcgctcggcactcatcaggcagaagaagccgtcgacgagatcggtcgcgaagcagaacgagcgtgtctgcatgccgtcgccgtagatctcgagcggcgcgccgttgagcgcgccgacgatgaagttcgacacgacgcggccgtcgcgcggcgacatccgcgggccgtaggtgttgaagatgcgcgcgacgcgcacgtcgatgccgtgcatgcggtagtagtcgtagcacagcgcctcggccgcgcgcttgccttcgtcgtagcacgcgcgcgggccgatcgtgttcacgttgccgcgataggtttccgtctgcggatgcacggccgggtcgccgtaaatctcgctggtcgacgcctggaacacgcgcgcgcccgtcttgcgcgcgagcgcgaggcagtggtgcatgccgagcacgttcgtcatcatcgtgtggacgggatcgatctggtaggtgggcggcgatgccgcgcacgcgagattccagatctcgtccacctgcagttgcggcaggccgagcgagacgtcgcccttcacgaactcgaagcggccggacgccttcaggtcggcgacgttgagcttgcgccccgtcagcaggctgtcgatgcacgtgacggaggcgccttccatgaccaggcgctcgcatacatagctgccgagaaagccggcgccgcccgtgacgaggacacgctgcccggcgcgcgtctcgagcgtgaccctgtcattcatggctttcaccttcgtcgttcagctcggggaaccacacgtcgatcagttcgacggcggcgcgcacgcgttccatcccgctgcacgggtgtcgcttcggcaagcgccggttcgcatgtgcggatgtcgacgaagcgccgcgacaggcgctccggtttcgctgactaccccgttgatgcttgaacgacgcaagcgtcgatcgatcggtggtgatcttcatcgccttttccccgatacgctgattgacgagcaggccgccgttcgtgatcttgtgccacggcgtgccgctcggtgagagccggatatcaggcaatcggcatgccatgaacgatgtcgacacgatgcgcacgggcgaggcggcgagattgcagcgtgatatgcgcacttctgtttcatgcgtgaatcgtggggccagaaaagcaggcaggccgattgccggatcgatgcgattcgatacgacgaaacacgagataaatcaggcttttgcgggattcgattcgtcaagaaggtgttgagcgggaatgtttcatcaatgagaaatgagcggataaaggactaaaacgtttctcgaacgtgcagcccatctggagatcgggtgattgaaaggctagggaatgaaagtgaaaaatgttgtgtggcgtccgggcgaggccgcgtgttttcatttgttttaattattacgccggtgcgaaagttttaatttttacggttatttcgacgcttgagtagagcgtgatcctgtcggtattttcacgaatgaatcaaattcgtttcggtcatccggagaaacgcgtgccgacggcatgcaggaggctgatgtaccgggctctccgggcattgtgccgggcgaatcgattctcgtttgtgatggcacggcaggggccgtacgcacgtcgaccggcggttcgcaacccgaaatgccggctccgccggccctgcgcggccatgcgcttctcaagtttgaaacactcgttcatctgaccatccggcgcacgcctgcgagccggattcgtccgtcaaatccggcagttgcgtcgcggcgcccgacaagcgccggggtgtcgaaccgccattacgatacattcctgaaacaaaaatgtcgttcctggcgatgcaggcagccgtggcggccgtttgccgtgtgcaatctccggtggaataacgagtggcacgctgcttgcggtactggacgcaccggcgggcggtcgacacgaagcaacgaacaggtggggcggccaactcgtcaatatgcagtcggggaaacggcgatgaagaccataagctgtaggttgatcggcgcgtactttgcgcatcagtggggtagtcggaaaggccggggtgacgctcgcgacgctgtgccagcatcgcgggttgcgctgtcccggtttcttgcccgccgcgcgcttcgcgtgctggcgcggttgtcgcgccgcacggcagtcgggcgacagcgacactcactttcattcggttcatcgggatggatcaggctgttcgtgccggacagcgtgatgccgattcgtcttcggccgtgcagggccgcttcgatcgcgcctggcccatgccggcgccggccggattagatcgaacgaccgtcggccggattatccggaagacctttcgtcgacagctcaggagacgacatgccacctggctgcaatgcaggcccgttgtcgcctgaataaaaggtgtatttttcaacgtcgctgcatttgcggtggttaatgtattcgcgaattttcgattccggaatggagtgccgcgtgccggcacgccgaccggcgggtatcgaatatcgcgggccggaaatgtgtctgcatctttccggcttgtcaggccgattgtgtttttaataaatccaatgttcataaaaataatagaaaacacctaccaaaaaatttggataaccaaaaacacgagactaagcttcgtctggccaaattcgcaaaaacagaaattgaaaaggcagcatgatttcttaatttgatagtgatccttaatttctaggattgctcaagtcaggaaggttgatggcgtgcgatcttcctgactcactccgtccacgccgttttggagtcgaccatgaagaagcttctgattgcagcagcagttctggcggtttcgggtgcagcgttcgcaggtagcggcacggtgtcgagcagcagctcgtcgagcggcggttcgacgatggcaggcgttgccggcttcggccatttcaccgcgaccgattccggctctgcactcggtgcagccggcgcacttgccggtggcccgggcagcggttcggtctcgtacacgaaccacacgcaatcgtcgtcggttagcggtttcggcttcggtggcgcacaggcaggtggcaccagcggcgcgaatgccggctcgatcggctggacggttcaccactattaagccgcgacgcgtagcgttcgtcattggctggcggtacggatgccgggttccgctcgatggggtagacccggctccgccaccgccgaacttactcacagcaaggaattgctatgaaagccaaagtcattttcgcgacagcgctcaccgtcatatcgtcggctgcattggcagcgggttcctccacgaccaaccagacacagtccgttgcggcgggtgtttccggttcggttctggtcggctctggcagctataccagcaattcgacttcgacggcgggcgcgaacgcgggcagtacggtgacacccgctggttccgccggcacggcatccgccttccacaacacgacttcgacggccagcggttcgggcacgaacggggcgcgttcgcggcaggcggcggtatcggtgccgcaggctcgtacggtggaaacagcaaaacgaacgagaacgcgaatgcgctgtcgggaggggtgagtgccacgatcgtgctgggtgcaaaccactacacggccagcagcgcgaacgaccagggcaatgccaacgcgggtgccgctggtctgaccggcagtgctgggtcaggcgcgatcacgggttcgaatcactacaactcgtcgaccgtgtggagtaccggttcggccggctcgccgtccgcatcgggcggaagcaacgccagttcaagtgcgaccggaagcagtcattagtcaggtgtgggggaccagtttcccagcgacgctggtctcttttgcccacattgttgtcacgtaaggagttggcatgaagcagaaactgattgccgccgctctgatgctcgcgtctctgacggcgtatggcgctgaccgtattgccaacgacgtgcaatcgaatttgcagacgtcaaacaaccctgaccagacaaccaaaccgtcagaacaacaaacgctttcttcgggcagtgccatcggcggaccagacgcccagcagtggcagggcatgtcggccggctcgtggtcccagctgggcaacggctggaagcagttcgggaagcaggcaaagctgaagggaatcagggaattagtacggttgcctgggtgggaggtaaaacctcgtccggagagtgaaatgaacagcaacaggatcaaggtggcatgcgctgcgatgttcgcgatgaccacgatcggcgcccaagcgcaaaccgccgattcgacttcgagcgcgcagtcgtcgacgtcgtcgacggcagtcagccagggcggcggctcgagcatgaacacgaacaccacgagctcgcgcggcggcaacgccaccagctccagcggggttcgcagcagcggcaattcgagcgtgaacgtgaacgtgacgatgccgtccagcacgagcggcggcacgaacgtgacgccgcagtcgctgcagtcgtccggcgcgcccggcaccaacccgtacaacacccagtcgtcggaaaacgtcaattattccggcacgcagacgatcaagacgaaccccgcgatccaggcgccgggcctcacgaccacgctgtccgatacctgcatgggatcggtgagcgtcggcgtgtcgttcccgggttcggcgcgacgggcggcacgacgctggtcgaccaggcctgcgtgcggcgtctcgatgcgcgtgaattccgtgcgatgggcctgaccgacgtggcgctcgcgctgctctgccagagcgacgcgaaccggcgtgcggtggaggcgaccgggcatctgtgcccgggcacgacgacgccgctcgcacgttcgaacgtggcgccgagcgtggaagcgacggtcgccgacgacgtgaagtatcgcgatccgatcgtgcgtgaccgcatgggcttgccgccgctgggcgctgccgcgccggcaccggcgcaggtccgcccggtggcgacgacctcggtgcaggcggcgcccgtgtcggtgccggtacccgtgcccgtgccgtcgatcgcgccggttgccgccgcgccggccgttgccgcaccggctgttgctgctgccgcgccggcaatggcggcgccggctgttgctgccgcagcccctgccgttgccaaacccgccattgcagccgcggcaccggccgtcgccgcagcgcctgcggtggctgccgcacccgctgtcgccgccgcgcccgcagcctcggtcgtaccggcggccgcgatcgccgccgtgccggctgccgccgtgctcgccgcgccggccgttgcggacaaggcatcgccggtacctgctgcgccggtcgccgacacgaaggccccgaacccgtgcagcccgtcgccgacaaggcaccggagcccgcaccggcggttgccgacaaggcaccggagcccgcgccggcggttgccgacaaggcgcccgaacccgcaccggcaatcgccgacaaggcccccgagcctgtgcagcccgtcgccgacaaggcaccggagccgatgccggccgcgaccgacaacgcagcgcaggccgctgccgcgccggctgcggatacgacgccggccgctgccgtcgtcgcggcgcccgcaaccgaggccgcgatgcccgcaccggcagccgatgcgaaggccgccgaaccggctccggtcgccgcggaagcgcccgcaccggaagccgcgcagcctgcagccactgcggccgcagcgcctgccgacatgccggcagccgatgcgaaggtgccggaccaggcagccgcgcagcccgccgagatgccggcgttgtccgatccggcgcaaggattgccggcggctccggtcgaccagcaggccgccccggctgtaccggtcttgccggctccggccgtcatctcgacgagcacgtcgtcgtaagcacgcgggtctggctcccgtgcgccggaatggcggcgcacgggagtcgtccgacccgatgcccgacggtcgtttcctgtttgacgggtgttggtcccatccccgaggtcaacacctcttttgcctgacgaggatgcaaggaggcctcaatcatgaggatctttttggtcgctctgttgttgtacagcgcacaagccgcagcacaggcggtatttcagaacccggcggtcttcgtgatcctgggcgagcagaccgcggcaaacgccgcgagcgtcgcgcaggcgctgacgacgctcggtcgcgccgacaacacggcgtgcgcgccgatgatgatgatcggcgatccgcagatgatctacatgatgccggaggagggtcacgcgccgtcgtggcaatcgccggtgtacggccgtggcgcgccgttcgaggcgcagagggccggcgccgaccggcaagacggtcggcgcgatgcagcatgccgaggacatgcagacgcagccatggagcgacggcagcgcgatcacgcagaagatcgcaggcgatgcgagcgtgacggcggcggaccaggtgagcggctggcagcgcaacgggctcagctcgatcgagacggcccgtgcgacggaagtgacggtgaacggcaagacctaccgggcctatcgtgacgacctcaacggtgccgcgaagccggtcgtcgagccgcagatctacacgcagcgcgtcgtttctgccgataacgaacgtcaatgcgaggacggcccggcgccgcgtcgcgggaccacggtgccccgctccacgcgatccggcaacggccgtttcgacaaccaacccaagcgacgaggccatcgtgaaccattgctgccagatcagggtgtcgggcccgcaggaactcgaacgcgatgcggggacggcgccgttcattgccgtccggcgcaaccatgtcgtgccgtcgcggccgctcgtctacctgtcgcagcagcacgacgccgcgctcgtcgattgtctcgcgtcgcgcggctgggacgtgtggcgcgcgaaaaccgttgcggacgcactgaatctcgtcagggcgaaccgtctgcatgcgggcatcgtcgatttcggcagcttcgcgtcgcccgacgtcacgtcgttcgaggcgctgctgcgcgacccgcgcgtcggctggctcgcgttcgccgacgacgagcggctgcgggatatttccatcgcgcgcctgattcgccactgctgtttcgattacgtgcgcaacccgactgcatacacgacgatcggctatctggtcggccatgcgtacgggatgctgaggctcgcggacggcagcccggacgccgatgcggcgccccggaggcacgatgatcggctcgtgcgacgctatgcgccggctgttcgcgacgatccgcaaggtcgcgaatacggaggcgaccgtcttcatcgccggtgagtccggcaccggcaaggagttgacggcggcggcgattcatcagcagtcgtcgcgcgccgacgcgccgttcgtcgccgtgaactgcgcggccattccgtcgacgctgctgcaggccgaactgttcggccacgagcgcggtgcgttcacgggcgcgcaccagcgcaagatcggccgtatcgaggcggcgcacggcggtacgctgtttctcgatgaaatcggcgacatgccgttcgagagccaggcgagcctgctgcgcttcctgcaggaaggcacgatcgagcgcctcggcgggcacgcgtcgattccggtggacgtgcggatcgtgtcggcgacccacgtcgacctcgaggccgcgatgcaggcggggcggttccgtgccgacctgtactaccgcctgtgcgtgctgcgcatcgacgaaccgccgctgcgcgtgcgcggccgcgacatcatgctgctcgccgaccatgtgctgcggcgctatcgcggcgacaatgcgcaacggattcgcggcttcatgccgagcgcggtcgaagcgatccacaactatccgtggccgggcaacgtgcgcgagctgatcaaccggatccggctcgcggtcgtgatgacgaacggcccgatgatctcggccgccgatctcgaactgcaccagtacacgtcgcggcagccgccgacgctcgccgaaacgcgccggcgggccgagcggcgcgcgatcgaggaaacgctgatgcgccaccgccaccagcatgccgacgtggcggccgagctgggcatctcgcgcgcgacgctgtatcggctgatgaccgcgcacgggctgcacggctgacgcgccgcggcgcgcagccgctcaagaccgcgcgacgtcggccgttaagacatgaaacggcccgtccggaccgccgcgcggcgatgcgcgcgcggccggcatgcggcgcatcacgcttatccgaggttaccgtggcagagtgcagtcactgcggcaggacgttcctggtcggcgggcggtcgatcgacggccgccgctattgccgtccggcgtgcgcccgggcgcatccgatcgtcgtcgaggcggagcgggtgcccgacgcgaaggtctgggagtatgtacacgactggcgttacgggccgtgcccgatctgccgtcgcgacgaccggccggtcgatgtccatgcgtcgcatcgcgtcgtgtcgctgctgttcgtcacgcgctgggcgacacggcgccacgtgtgctgccggcgttgcggccgcaggaagcaggcggtcgcgttgctggcgtcggccgcgttcggctggtgggggctgccgtggggcctcgtgctgacgccgatccagctcgcgcgcaacgcgctcgggctggccgcgcgcgatccgcaggtcgcgacgcggcagttcgagcagctcgtgcggcgcaagctggcggcgcgccggctgcagcgcgcgcggcagggcgccggcgcctgagcgtgcggcgcggcgtgccgcgcgatcaggaggccggccgctcgaagcccgaggcgacccagcgctcggcaccggccttgttgagcttgaaaccggccgacaccttggcttcggccagcagctcgccatacggatcgaatgccttgagctgcgcgtaaggctcgaattcgtccggcacgatgtcgagcgtcaccgacacatcctggccgtcctcgccctgaaccgtcacttccttgtgcagcatcgcgcgccgctgctgctcgtggcgcatcagcacctcgctcgcggtcttcacgagcgtgcggaacgcgttcgcgtccatcggcttggggttcttcttgtcgcggcccatggtccacggcccgacgagcgcgggctcggactcgccgtccttgatcatttcgacggcccagccgtcgtcgtcttcgttcttgatgatgcgggccgtccagccgttgtcgcgccagaggccgtcttcgtggatggaggtgtcgtcggattgcaggtcggattcggtcatgaggaaagcggggcggggccaccggagtacgggcgcgggcacggggcggtggcgcgcggccggcatcggcgcgtcgctcgccgccggcggcccggcgcggcatgcaaaggcgtcgattttacctgctggccggccggatggcccgtgtggcccgccacgccggccatccggccgatgttccgaggtgccggccgctccgggacggccgctcgaaccggcgcaaatatcaaactcgtattacgtccctgacgaccaatcccgttaccgtccgatatcccgtccgcgtgcggcttcatagaatctgtgtgcaggctaaaaatagcctgaacgtccgatcaacgccaaaccggccgtgcgcgtccgcgtcgcgcggccgatgaaccaccgggaaccacgcatgaggaaattcaacgttcgcatcgtcttcgcgtacgactggccgttgacgctggccggcatcgagcaggtcgcaggcagcgcctgcgcgatcgagctcgtcgcggtatgccggaatgtggccgagctggccgcgtcgctcggcggcgtcgactgcgatgtcgtgctggtcgactatgcgatccgcggggacgcgcagatggacggcctcgggctgctcgactggctgcggcgcacgcgtccgaacgtcggggtcgtcgtgctggtcgcgaacgagaatccgctgatcgtcgggtcgatcctcgcgatcggcggcgtgagcgtcgtcagcaagttcgacgaggtcggccatatcgtcacggccattcattcgagctacagcggcgggcactacctgtcgccgctcgtcaggcgcgcggtcgatgcggccggcgagcgcggcgaggcgcctgtgaagctgtcggcgcgcgaaatcgaggtcattcgcctgtatctgtcggggtgccgatcaagacgatcgcgcagcgtctgagcaagggcaagcagacggttagtgcgcagaagatcagcgcgatgaagaagctcggcgtgaacaacgacgtcgagctggtcaggcgggcggcggggctggggctcggcaccggtgcggccgcgccgcggcccggcgacgcggcgtgagcccgcgcgcgccgggcggccgccgtcaggccggcaacgcaaaccgcgtcacggcgtcccgcagcgcctcggcctgatcgcgcagcgaatgcgcggcggccgccgcttcttcgacgagcgccgcgttctgctgcgtgacctggtccatctcgcccaccgcgcgattgacctgctcgatgccggcgctctgttcgcgcgacgcatggctgatctcgtcgaggatctcgttcacgcgccgcaccgactgcacgatttcggccatcgtctcgcccgcgtgcgtgacgagcgccgcgccttgctcgacggtctcgttcgacgacacgatcagcgacttgatttccttcgccgccgtcgccgagcgttgcgcgagcgagcgcacttcggccgcgaccactgcgaagccgcgaccctgttcgcccgcgcgtgcggcttcgacggccgcattcagcgcgaggatgttggtctggaacgcgatcccgtcgatcacgccgatgatgtcgccgatcttgtgcgagcggtcggtgatctcgttcatcgtgcgcacgacgtcgtcgaccaccgcgctgccgcgcgtcgcgacctgcgcggcctggccggcgagcgacgcggcctgggcggcgctgtccgcgttctgcttcacgttcgcggtcatctggtccatgctcgacgcggtctgcacgagcgcggccgcctgttcctcggtgcgctgcgacaggtccgtgttgcccgacgcgatctcgcttgcgccgacgttgatgttctcggtacccatccgcacgcgcgacaccatgtcgatcagcccgccttgcatcgtgtgcagcgcgtgcagcaggctgccgcgatcgtcgtgcttcacggcgacgtgcgcggtcaggtcgccctgcgcgatgcgctgcgcggcgtcgagtgccacttccaactcgccgccgaggttcgcgcgcacgcttttcagcaccagcaccatcacggcggtcgcgatcccgccgagcacggtcgtcatcgcgagccagcggccgacgctttcgagcacggcggtgcgcacgtcgttcatgtacatgccggtcacgatgtaccagtcccagggcgcgaagcgctgcacggcgctggttttctcctgcggcttgtcggcgcccggcttcggccacagatactcgacgaagcccttgccgccttcgaggttgccggccttcacgatctcgacgaacaggtgcttgccgttcggatcggtgaaattcgacacgtccttgccgttgaggtcggccttgatcggatgcatcacgatcacgggcttcgagtcgttgacggagatgtagccgtcggcgccggaacgcatcgcggcgatcgcctcgagcgccttctgcttcgcgtcggcttccggcagcgcgttctgctgcgacagcttgtagtagtgatcggtcacgctcgcggcctgcgcgaccagcgacgcgagctggtcgcggcggtccgcgatcatcgatgcgcgcgtctgccaggccccgagcccggcgatcacgagcaggccgagccagaggatgacgatcatcgaggcgagtttctgattcaggaaaggttgcgcatggtgtgtggtcggtcagtcgtggaagctcgccggggcggcgtgacgggataagtatcttgacggcgcccgacgtgcgttgccgtaggcgggttatccctaggagcccggcgccgtcgccgatgccgtcgacaccgacaagggcatctatgcatatgcataacgggcgtcgctatactgtcggggcgtttgaatgcgcgccgcgcgcgcggcggcgaatgaaaccgaaaggaggcaacgatgcgaattctggtggtgggggccggcgcggtcggcggatacttcggcggccggctggccgcggcggggcgcgacgtgacgttcctggtgcgcgacggccgcgcggccgcgctggcgcgcgacgggctgctgatccgcagcccgcgcggcgacctgacgctcgcgaacgtgcagaccgtgcgcgcgggcgacgcgggtgccggcgtcgcgccgttcgacctcgtgctgctgagctgcaaggcgtacagcctcgacgacgcgattgagtcgttcgcgccgttcgtcggcccgcagacgctgatcctgcccatgctcaacgggatgcgccatctcgacgtgctgcgcgagcggttcggcgccgcgcaggtgctcggcgggctgtgcgtgatcgcggcgacgctcgatcgcgagcagcgcatcgtgcacctcaacgacacgcacggggtcacgttcggcgaactcgcgggcggcgaatcgccgcgtgtgcgtgcggtggccgaggtgctcggcggcgcgggtttcgatgcgacgctcagtgacgacgtggccgcgcggatgtgggaaaaatgggtgttcctcgcgacgctcgccgcgagcacgtcgctgttccgcgcctcggttggcgacattctcgccgcgccggacggccgccgcctgctcgagacgatgctcggcgaatgcagtgcgattgccgagcacaacggccaccggcccgatccggccgccatcgagcggatgcagcggatggtgctgacgccgtcgccgctgaccgcgtcgatgctgcgcgacgtcgaaaaccatgcgcgcgtcgaagccgatcacgtgatcggcgacctgctcgcgcgccgcgacccgcaggcggccgatgcgctgtcgctgctgcggatcgcgtacaaccacctgaaggcgtacgaagcgcgtaccgcgcgcgagcacgcggccgcgtaagcgccgagcaggcggccgcccggccgttccgcactgcacaaattgccatccggcgccatttgcggccggaatgggcaaaaagtatcgaaaatcaggcgtaaagttggtggagccgcgcgctcgatcgacctacattgcttcccatgcgaccggtcgcgtcgccgcgtgaaatacgcggcgcacgcgcaaaacgaaccggccggcgagacacgggaatggagacgcccacatgatgcaccccgatctggaagtggtcgaagtgcgacgcgacgagtcgttcaaggtctggtcgcacggttatccgtatcgcacgatccgctggcacttccatcccgaattcgagctgcacctgatcgtcgcgacgcgcggcaagtatttcgtcggcgaccacatcggttcgttcggccccggccatcttgtgctgctcggcccgaacctgccgcacaactgggtcagcgacatggccgaaggcgaaaccgtcgaacgccgcaatctcgtgatccagttcgacccggcgttcgtgcgccgctgcatggacgcgttcccgaatgccgcgacgcgcaggcgttgctcgacgatgcgcggcgcggagtcggcttcgacgcggcgaccagcgccgcgatcgcgccgctgttcgacgaactgctggccgcgcgcggcatgcgccgcatcgcgctgttcatgacgatcctcgaacggctgtgcggcgcggccgaacgcacgctgctcgcgagccccgcgtacgaccaggccgatgtcacgccgacgcggctcagccatgcgctgtcgtacatcggcaagaacctcgcgtccgagctgcgcgaatccgatctcgcgcaactgaccgggcagagcgtcagcgcgttctcgcgcgcgtttcatcgccagacgggcatgccgttcgtccagtacgtgaatcgtctgcggattgaatccgcgtgccagctgctgctcgccgacgacgcgaacatcaccgatatctgcttccaggccggcttcaacaacgtgtcgaacttcaaccgccagttccgcgcggtgaaggggatggcgccgtccgaattccgcgcgctgcagcgcctgaacgcgcgcagccgcgaactggcgctgcacgcggcgcccaccggcaatccgctgccgccgcgcgtcgtgacgcccggcgcgcccgaactcgccccgcagcccggatgatcgcggggccgccgccggcccgagttttccacgccgtttcacccagccgatcgcgccgcctgcgtcgcgaggggcttgctcacccacgaaaaagccttatacaaccggagacaccgtcatgacgcctgcatcgcccgcctcattccccgtcgcgccgcccgtctggcggcggttgccgcgcttgccgccgcggcctggctgcccgccgccgtgcaggccgcaccgctgcggatcggcatgacgttccaggaactcaacaacccgtatttcgtgacgatgcagaaggcgctgaacgacgcggccgcgtcgatcggcgcgcaggtcgtcgtcaccgacgcgcatcacgacgtcagcaagcaggtgagcgacgtcgaggacatgctgcagaagaagatcgacatcctgctcgtgaacccgaccgattcgaccggcatccagtcggcgatcacgcaggcgaagaaggccggcgcggtggtcgtggccgtcgatgcgaacgcgaacggcccggtcgattcgttcgtcggctcgaagaactacgacgcgggcgtgatgtcgtgcgactacctcgcgaaagcgatcggcggcagcggcgaggtggcgatcctcgacggcattccggtcgtgccgattctcgaacgcgtgcgcggttgcaaggcggggctcgcgaaatacccgaacgtgaagctggtcgacacgcagaacggcaagcaggagcgcgcgaccgcgctgtcggtgaccgagaacctgatctccgcgcacccgaagctgaagggcgtcttcagcgtgaacgacggcggcgcgatgggcgcgctcgccgcgatcgagagctcgggcaaggacatcaagctgacgagcgtcgacggtgcgcccgaggcgatcgccgcgatccagaaaccgaattcgaagttcatcgagacgaccgcgcagttcccggccgaccaggtgcgtatcgcgctcggcatcgcgattgcgcgcaagtggggcgcgacggtgccgaaggcgatcccggtcgacgtgaaggtggtcgaccgcggcaacgcgaagggcttcgctggtgaacgacgtgcaatgcgactcgaagggcggcggcacggccggcgcctttcgtacggagaaaccgatggacacgatactccggctcagcgacatcgcgaaaagctttccgggcgtgaaggcgctgtccggcattcatctcgagatcgcgcgcggcgagattcacgcgctgctcggcgagaacggcgcgggcaagtcgacgctgatgaagatcctgtgcggcattcatcggccggataccggcacgatcgaaatcgacggcgaggtgcgtcgtttcgcggactatcgcgacgcggtcgcggcgggtgtcggcatcgtgttccaggaattcagcctgatcccgcatctcgatgccgtcgacaacctgttcctcggccgcgagctgcgcaaccgctggggcgcacgcgaccgcaagcggatgcgtcgcgcggcggccggcatcttcgcgcggctcggcgtcgcgatcgatctcgatgcgccgatccgtgcgctgtcggtcgcgcagcagcagttcgtcgagatcggcaaggcgctgtcgctcgacgcgcgcatcctgatcctcgacgaaccgaccgccacgctcacgccggccgaggccgggcacctgttcgcgatcatgcgcgagctgaagcggcagggcgtcgcgatgatcttcatctcgcatcatctcgaggaaatcttcgcggtgtgcgaccgcatcaccgtgttgcgcgacggccagtacgttgcgacgaccgacgtcgcgcgcaccgacgtcgagcagctggtgcggatgatggtcggacggcggatcgagagcagttttccgccgaagccggcgcgcgcggcggatgcgccgcgggtactggaggtcgatgcgctgcagatcgagcgcgacggccccgtgaaccgcttcgcgctgcatgcgggcgagattctcggcttcgccgggctggtcggctcgggccgcaccgaaaccgcgctcgcggtgatcggcgcgacgcgtgcgcatcgcaaggacgtgcgcgtgcgcggcacggcggcgacgctcgccgatccggccgacgcattgcgcgcgggcatcggcatcctgccggaaagccgcaagacggaagggctcgtcacgtcgttctcgattcgcgacaacatctcgctgaacaacctcggcaagtaccggtcgatgcgctggctgatcgaccgccgcggcgagcgcgcgcgacgcacgacgtgatgcggcgcgtcggcgtgaaggcgccgtcgatccatgccgaggtcgcgacgctgtccggcggcaaccagcagaaggtcgtgattgcgcgctggctcaaccatcacacgtcggtgctgatcttcgacgagccgacgcgcggcatcgacgtcggcgcgaaagccgaaatctacgggctgatgcgcgaactcaccgcgcgcggctacgccatcatcatgatctcgtccgagctgccggagatcgtcggcatgtgcgatcgcgtcgccgtgttccggcaggggcgcatcgaggcgacgctcgaaggcgacgagatcgatcccgacacggtcatgacctatgccacggccggtatgcgaggagcgacccatgaacctgcctgattcttcttccacgtcttccacgacgctcgcggctgccgccgcaaacggcgacgcgccgccgccgcgcgcgatgtgggcgcagttgcgacgctcgacgctgttctatccgctcgtcggcctgatcgtcgtgtgcatcgcgatgatgatcgcgagcccgagcttcctgtccgccgcgaacctggagaacgtgctgcgccaggtgtcgatcaacgcgatcatcgcggtgggcatgacctgcgtgatcctgaccggcgggatcgacctgtcggtcggctcggtgatggcgctgtcgggcacgctcgcggccgggctgatggtggccggcgtgaacgcggtggccgcgctcgcgatcggcatcgcggtcggcctcgggttcggcttcctgaacggcctgttcgtcgcgttcgcggggatgccgccgatcatcgtcacgctcgcgacgatgggcatcgcgcgcggcctggcactgatctacacgggcggctatccgatcgacgggctgcccgactgggtcgcgttcttcggcagcggcaaggtgttcggcatccaggcaccggtactgatcatgctggtggtctatgcaatcgcgtggctgctgctcgaccggatgccgttcggccgctacgtgtatgcgatcggcggcaacgagcaggcgacgcggctcaccggcgtgcgcgtggcgcgcgtgaagctgatcgtctacacgctggccgggctcacgtcggcgctcgccgcgatcgtgctgaccgggcggctgatgagcgggcagccgaatgccggcgtgggcttcgagctcgacgcgatcgcggccgtcgtgatgggcggcacgtcgatctcgggcgggcgcggcgcaatcctcggcacgctggtcggcgcgctgctgctcggcgtgctcaacaacgggctgaacatgatcggcgtgaacccgtatgtgcagaacgtgatcaagggcggaatcatcctgctcgcgatctacatcagccgcgaacggtcgcggtaacgtgcgatcgatcagacatccgaatcatcaacgaaagagacaactcatgacgacacccgaagcccagccgcggatgaccgcggtcgtttgccacggccccgaggactaccgcgtcgaacaggtcgcgaagccgcgccccggcacgaacgaactcgtgatccgcatcgccgcgtgcggcatctgcgcaagcgactgcaagtgctatacgggcgcgaagatgttctggggcggcccgaacccgtgggtcaaggcgcccgtgattcccggccacgaatttttcggccatgtcgaagcgctcggcgacggcgcggccgagcacttcggcgtgacggtgggcgaccgcgtgatcgccgagcagatcgtgccgtgcggcaagtgccgttattgccggtcgggccagtactggatgtgcgaagtgcacaacatcttcggcttccagcgcgaggtggccgacggcggaatggccgaatacatgcgcattccgcccaccgcgatcgttcacaggatcccgctcggcgtgtcgctcgaagacgccgcgatcatcgagccgctgtcgtgcgcgatccatacggtgaaccgcggcgacctgcagctcgacgatgtggtcgtgatcgccggagcgggcccgctcgggctgatgatgacgcaggtcgcgcacctgaagacgccgaagaaactcgtcgtgatcgacctgatcgacgagcggctcgaactcgcgcgcgagtacggcgccgacgtgacgatcaacccgacgcgcgacgatgcacgcgagatcgtccggtcgctcaccgacggctacggctgcgacgtctacatcgagacgaccggcgcgccggtcggcgtgagccagggctcgacctgatccgcaagctcggccgcttcgtcgaattcagcgtgttcggcgaggatgcgaccgtcgactggtcgatcatcggcgaccgcaaggagctcgacgtgcgcggcgcgcacctggggccatactgctacccggtcgcgatcgacctgctcgcgcgcgggctcgtcacgtcgaaaggcatcgtcacgcacgatttcgcgctcgaggagtgggacgacgcgatccgcgtcgcgaaatcgcccgaatcgatcaaggtgctgctgaagccggctcgctgacggccggcgcgcgcctcaccggagacatcatggaatacgtcataggcgtggacatcggcacgcagagcaccaaggcgctgctcgtcgaccggcgcggcacgatcgtcgcgcggcgctcggccggctaccagcccgatacgccgcgcccgctgtgggccgagcaatggccgcaggtgtggttcgacgccgtgctcgaatgcatcgccggctgcgtgagcgatgcgcgcgcgcagggtgtgccggccgacgcgatccgcgcggtgtgcgtaggcagcctgtacggcggctcgggcattccggtcgacagcgacatgcggccggtccatccgtgcctgatctggatggaccggcgtgcgaccgcggaagtcgactggatcaatgcgaacgtgaacgtcgagcggctgcgcgtgatcacgggcaacggcgtcgacagctattacggcttcacgaagatgctgtggctgcgcgaccagcggccggacgtgtgggcgaacgtgcgctacttcctgccgccgaacgcctacgtgatctacctgctgaccggcgaggtcgcggtcgatcacagctcggccggcaacatcggcggcgtgtacgacgtcgcgcgccgcgaatggtccgacgatgcgctcgacatgctcggcatcccggcgacgatgatgcccgagcggctcgtcgaatcgacggacgtcgtcggcggcctgctgtcgcaatggacggagcaactcgggctgccggccggcacgcccgtcgtcgcgggcggcgtcgatgcggccgtcgcgaccttcgcggccggcgcgacgcgcgcggggcagcatgtcgcgatgatcggcaccagcatgtgctggggttacgtgagccggcacgtcgatgcgcggcacgggctcgtcagcatgccgcacgtgttcaacgggcagcgcgacctgtacgtgttcggcggcgcgatcacggcaggcgcgtcggtcgcgtggtttcgcgaccagttctgtcacgcggagatcgatgcggcacgcctgctgccgcacggcgatccgcacgtgttgctcgaggaggcggccgaaagcgtgcctccgggcgccgatggcgtgctgttcctgccgtacctgatgggcgaacgcagcccggtgtgggacgcgaaggcgagcggcgcattcgtcgggctgagtctcgcgcacacgcgcgcgcatctgtatcgcgcggtgctcgaaggtgtcgcgttcgcgttgcggcacaacatcgaggccggccgacgcggagcggccgcgctcgacgaccggctgatcgtcgtgggcggggccgcgcattcggcgctgtggatgcagatcattgcggacgtgacgggattcccggtgtggacgatcgagcaggacgtcgaagccgcgatggggcggccctgctcgcgggagtcggggtggggctcgtgtcgcacgaggatgcacaaggcggatgggtcacgctcgtcgagcgcgcgcggcccgatgccgaacgcgcggcagcctatacggcgcgctttgcgctctatacggcgctgtatccggcgctcgaaccgatcatgcacgggttgcacacgccatcatgaaaagtcgattcgatttcggcggttcgcgggtgctcgtcacgggcgcgtcgagcgggatcgggcgcgcgtgcgcggtcgcgctggcgcgggcgggcgcgcgggtcgtcgcggcggggcgcgacctggccgcgctcgacgcgctggccggcgaggttgcgtgcgagacgttgcgcgtcgacgttggcggtgacgagcacgcgatcgatgcggcgcttgccgcgcacgacgcgttcgacggcctcgtgaattgcgcggggatcgcgtcgctcgaatcggcgctcgacgtgagcgccgcgcatttcgatcgcgtgatggcggtcaacgcgcgcggcgcggcgctcgtcgcacgggccgtcgcgcggaagatgatcgcgcgcgacggacgtggcgcagcgcaggcgcggggcagcatcgtcaacgtatcgagccaggccgcgctcgtcggcctgcccgcgcatctgggctattgcgcgtcgaaggcggcgatggacgcgatcacgcgcgtgctgtgcatcgaactcgggccgcacggcattcgtgtgaacagtgtgaacccgacggtcaccctcacgccgatggcgcagttcgcgtggagcgatccggaaaagcgtgcgccgatgctggccgcgattccgctcgggcgatttgcggagccggacgaggtcgtcgagccgatcctgttcctgctgagcgatgcggcatcgatggtcagcggcgtgtcgctgccgatcgacggcgggtacacggcgcgttaggcaacgtcgtactcgggcgccgcatgaccggaacccgtggcgaatgcacggcgaatgcgcggcgcggccgcccggcggctagaccggatccttgctcggcgggccgtccggttgctgcgggttgtcgtgatggccgggcggcgacgagaacggatcgtcttccgggtcgcggttcgggtcggccggtggctcgggcgtcggggtcgtgtgatcggtcatggagaactcgcgcagtgcgtgacggcggtggcgcggcgggggcgcctcgtctccgttataggcaatcggccgtgcatttgcagcgggattgtcgcggtggagcgcctttcgtcggtgcaatccgcacggacgcggttttcgtgccgacacctgctgcgcgggagcgggccatgcgccgctccgcgtgcggggcggatcggtgtcagcgcaaatccgcgggtgtatcgacgtcgcgcacgatgcccggatcgtcgacgtcgagcagcctgactggtgcactggcgaacagcgcgcgggcgccggtgtcgccgtcgagggcggcgagcgcatcgaagtggtgcgcggcgaaaccgaccggatggccgcgcgcgccgcgatgcgcgggtgcgacgatcgacgcgtcgtcggcgtcgagcgcgcgtgtgacgctttcgtaggtggacgccgcgatccacggcatgtcgccgagcgcgacgagccagccgttcgcgtcgggcgtcgcgcgtacgccggccgcgaggcttgcgcccatgccgcgcacggcgtcgggcgcgtagacgacatggcagccggcttcgttcagcagcatcgcgagtttttcggcaccgggacgcacgacggcgatcacgtcggccgtggccgccgcgagacggcgggcggccgcgaccgcaaccggcgtgccgtcgggaagcagcgcgagcagcttgctgtgcaggccgctcgggtcgaagcgttgaccgaggccgccggcgaggaggacgccggtggcgagtgacgcataggacatcggcgcggggagagtgatgcaggtgctgcgattgtgcgggagcgggcagggatcgacaagtgaggatgttaccggggcgggttcgttttgtcggaaagaacgtcagcgcgcggcttcgtcgagcatgctttcctcgacgggaccgtaaattgcgtgcgactggttgtgcatgacggcccaatagcggtcgccgaatgaccaatgccaccattccgacgggtaattggtgaagccggcgcccgtcagcgcggcgatcagcacctggcggtggcgggcggcagcccggctgatgaacgggttgtgcgtataacacgcgccggacgattcctggtcggttgcgtcgagcacgcagcccatgtcgagctcgacgccgtccgtcgagatcagtgtcaggtcgacggccgcgcccgtcggatgggcggcgacttccggcggcgcgacgtagtggctcgtcagcgcgaccaatgtgtcttcgtccggcagcgggttcagcgtccggcgcaggtgcgcgagatgccgggtgaagtagtggcgttgcagcgccagcggacgatagccttccttgacgtacaggcgcaggccgtcgggcagcgcgtgcgcggcggcgatcagccgttgcgccacaccgtggcgcactttcaggaaatgccggctcgagtgtgcggcgtcgtcgcggccgggatcgacggcgatgcggtcatgaaaaccggcgagatcgacaaacccttcgtgcgactccagcagggcgatcgaccggacagcgggatcggagagcgatatcacgctagcggacggaatggcgcgatgacggttgcgggccatgagccggcgccgaggctggccggccgaggtcgtttttgtcagacgattcgccaatatgccagagtccggcggaggatgcgcggcggttcggcctgcgggcaggcgacgctcaccagagcgtcttgacgtgcgcgtaagcgcggatttttcgtcgcgcgtgacgagcggcgcgccgagccgtcgagcggtcgcgacgatcatgcgatcggccggatccttgtggaacgcgccggggaggttggtggatttcgcggcgatgtcggcgtcgacgggcacgaagcgcatcccgtcgatttgcgcgacggtggcgagccatacttcgacatccatcgtcagtgcgaggcggtcgttgcgcaccagcatcgcaatctcccacgcggagatcgcggacgcggcgagcgcgccttcgctccgggcgcgatcgatcgcgcttctcgccttcttgctgagcgacgggtcgcccgccacccaccataccaatgcatgtgtatccagcacgatcaccgcgacgcctcccaatcatcttccgcaatcggatcgagaggattgtcatagcgcatgaccgagccgcgcaatatgtccaacggctgagcttcgcgtgcgtgatacggccggatctcgagcgtcggcttgccgtgatcggtgacgatcaggctttcgcccgacgcctcgacgagccggaagtattcgagtgcgcgggccttgaattcggatttcgatacgggagcgtgcggcatcatgatatgagcatggtcatttgacggtggtcattttagtcatggagtctgacgcagcgcaagcgccgggggcagcgttaaccgttcgcgttacgcatccgcccgcttcctcaacaggttgtgataaatccccgtcaacgcaatgaccatcgggtccttcgcgcctttctcggcggacagcgcctgaatctgcgtatcgagctggaacagcagcgtgcggtcgccgtcgtcgcgcaccatgctctggatccagaagaacgacgcgacgcgctcgccgcgcgtgacgggcgtcacatgatgcaggctggacgccggatacagcacgagatcgcctgccggcagcttcgcgcgatgggtgccgtacgtatcctcgacacacagctcgccgccgtcgtacgcatcgggttcctcgagaaacagtgtcgccgacaggtcgctgcgcacgcggaaatccgtgccgcgcagcagccggatcgcgttgtcgacgtgcgtgccgaacgtctcgccgccttcgtagcgattgaacagcggcggaaacaccttgagcggcagcgctgccgaaaagaacagcgggtggcgcgcgagcgcgtcctggatcgcgtcgcccaccgcacgtgcggcgggcgagccttccggcaattgccggttgcgtttcgcgagcgccgactgcgtgccggacgtcgcgttcccgtcgacccattcggccgcgtcgaggtggtcgcggcattgcgcgacctgcgccttggtcaacacgccggggatatgaagcatcatgttgcggattccatgacgtgcggcgccagttgcattgccgccgcacgaaatgcgtcgatcggcgacgacgcgagatacgcgcgcatcttcgcgacgaacgcgggggtagcggtggccggcacgcgctcgagccagccgagcgcttcgtcgatgcgtccgcgctcggcaagcagccgcgcatagttgaactggccgcggaagtcgccggcgacggcggcgcggcgatagtggtcgaacgcagcgtcggggtcggccggtacgacccagccgtcctcgtagaagccgccgatcaggttgatcgatttcgcatggccgagcgcggccgcgcggcggaaccagtcgagtgcgtcggcgcggttctcgtcgacgccgttgccgagcgcgagcgccgtcgcgtagttgtacatgccccagtcgagccccgcctgagcggcgagccggtaccagtacacggcgaccggcgcgcacgcggccgtgccccagccgaactcgtagcagcggccgagcatgttcatcgccatcgcgtggccggcccgcgccgcgtgccggaaccagttgaacgcggccgccgggtcgcgcgcgacgccatgcccgtcgagcaggtactgcccgtagacggcctgcgcatcgacgatgccgttgtcggccgccgcagcgacccacgcggcggcgcactcgggcggcccggccaggatgtcggcgaactcgcgcggcgataccgacgcgagcgccttcagcgacacggcctccatcgatcagtagcgcgcgttcagcgtgacgaacgccgagcggcccggtgcgatcgacgcgtagtgtgccgggtacgcctggtcgaagtaggtgcggttgaacaggttgttcacgttcagttgcaggtcgagcttcttgttgatccggtactgcgccatcgcgtcgaagcgccagtacgacggcaccgctcgcaggttcgcgggatcgccgaacacttccgacatgtagaacgcgccgccgccgaccgtgaacttcggcgtcacgtcgtagttcgaccacatcgtgaggctgtgcttcggcgtgttcgggaagcggttgccgttgttcgccgcgtccttgccgttgtcgcgcagcgcgctcttcatgtacgtgtagccgccgaacacctgccactgtttcgtgatctgccctgcgacgccgagttcgagaccctgcacgcgcttgttgccgaccatcgcgtactggttgttcggcagcgtcacgcgcgcgttcgtcgtatcgatctggaacagcgcggcggtgagtgacagcttgtcgttcagcacgttccacttggtgccgagctcgatgctgcggttcttctcgggcgccatctggtcggcgttcggaccgacgccgccgcggcccggcgtgagcgactgcgtttcgctgccttcgccgagcagcatgccggccggcgtcgacgacgtcgcgtacgacgcgtagatgctgccgttctgcgcgggcttgaacacgaggccggcctgccagttcacgagcgtgtcgtcgcgcgtataggttttgccgccgttggccttggtgtcggtgaagcgggtcgagtagtcgtcgacgcgcacgccggcgttgacctgccagcgcggcgtgatctcgatcgtgtcgaagccgtagatcgacttcgtcgtggtgcgtgcgtgcgcgtagtcgttgttgcgcgtgatcgaaccggcccacgggtcgttcgggttcggcgaccacaggctcgtgcagttgtagcccgatgcggcgccgatgccgttctggcagaccttgccggtgtcggtcgcgaccttgtatgaatcgcgcttgccccattcgcgcgtcagctcgatgccggtcgtgaagctgtgcttgaacgggccggtgcggaactcgccgaacagctcggtcaggttcgccaggctgttgatcgagctgtcgcggttgttgttgcggcgccagaccttgccgttcaccacgttgccctggctgtcgtccggctgggtccagatgtagtcctgcgtcgattccgtgtaacgcgtggtgttgcggatcgtcagcgccgacgtgatgtcgtgctcgatcttgatcgtgctgatgtccgacgtggtcttgcggaagtcgcggtcgatcagcccgtagaagttgtggcggtcgacggggccggatagatcgtgccgacgttcgccggtttgttcgacgccgtatagaaatacgggatgccgccgtcgggcatgtcgtcggtcgacaggtggtagtagctcgcggttacgcgcgtcggcgtgccgaggccgaacgcgatcgacggcgcgacgccccagcgctcgttgttgacggcgtcgcggccggcgacgtcgttgttgtggctcatcaggttcaggcggaacgcggcgtgatcggcgaactgccagttgccgtcggccgtgaagcggcgatagcggtcggtgccgaggcccgcgctcgcggcggcggtggtgccgaggtgcggggccttcgtgatcaggttgatgctgccgcccgcgccgccgcggccgccgtatgcgccgtcggaacccttggtgatctcgatgcgctcggtattgaagatctcgcgcgtcgtggcgcccgtgtcgcgcatgccgtcgacgaacatgctgccctgcgtgtcgtagccgcggatgaacggacggtcgccgagcgggttgccgccttcgccggcgccgaacgtgatgccgggcacggtgcgcagcgcttccgtcagcgtcgacgcgccgctgttctggatcagctcctgcgggatcacggtgacggatttcggcgtgtcgacgagcggcgcggtgaatttcacggaagccgagaaatcggccttgtagctgtgctcggccttgccctgcacctcgatcggcgcgagatggccttcggtgccggccggggcgggcggcggcgtgccgtccgccgcgaatgccgggctggcggcgagcacgctgcacagggtggtgaatttgccgagcttcagctcgtcgggacgtgacttcatggtgcgcttcgacctcgcggtgtggccccggggcggtgcgctacggaaatgtgcacgccgccgggaattattacgatttgttttcaggcggcattctatgtaatttcatcgcgaatgagaagcgttcttgttctcgtttgttaggaattgttgacgaatgtgacgggggcgttgagggggagattggccgaatgaccagatagaaagggcttgtcgggccggttagagtcgcagtgtcgcgattcacttggtatgacagcaaaatgctaatatgactgcattgaaagcaatcttgatgaggcgcaccatgccggtgatcaccgtccgaaatctgtccgatgaagtgcatcgagcacttcgcattcgcgcggcccaacatgggcgcagcaccgaagccgaggtgcgcgacattctcgaacaggccgttcttccgggcgggcggctcaagctgggaacgatgctggcggcaatcgggcaggaggccggcggattcgatttcgacgcccagcgcgacaagacgcctgccgatccgatgagcttcgaatgatccttgttgatacgaatgtcatttccgaaccgctacgacgcgagccgaacgcggccgtgatcgagtggctcgatgcccagaatgtcgaaaccttgtttctggctgcgatcagtctcgcggaaatacgattgggcgtggctgtattgccggaaggacgccggcgagagtggctgcatcagagcatcgagcagcgcgtgctgccgttgtttcgcggacgaatcctgccattcgacgatgctgcgagtaaagcgtatgcgagccttcgcgcccgcgctcgtgccgcaggtgtcgcaattgcaccatccgatggttttatcgccggcacggccgaagcgaacggcctgatcgtcgccacgcgcgacgtcacgccgttcgaggcaatggggattcgcgtaatcgacccgtgggcgcgctagcgagcccacggctgccggccccgcaggctgccccgcaattgaaaaacgcgccgtgcgatgcggcgcgttctgcttcaggcaagcgcgccgccgacctgaaacgacggcaggcgggcgcgagaccctggatacggttcaatcgacgccgtgaaacaccgcgtcctccggcccgagatatgccggcgggcgccacgtcgcgtcgcgcatcgaatgctggacgaggttctcgacaccgagcagcaccgcgaagatcgccatccgcaccggaatgccgttgtcggtctggcggaagatcgcgaggcgcgggtcgcggttcaggtcgaccgacaggtcgttcgcgccgggccggctgtcgcgcggcagcgggtgcatgatcagcgtgtcgggcttgcacaccgtgtcgacgagcgcctggttgatctggaaatccggcgtgtagccttcgaacgactcgtcggtgaagcgctccttctggattcgcgttgcgtagacgacgtccgcgccgcgcagcccggccgcgaggtcggtggtctgctcgatcacgtggccgttcgtcgcgatctggtcgacgatgtaggccggcatctcgagcgtcggcggcgacacgagcgtgaacttcagcccgcggtacagcgcgagcagcttgacgagcgagtgcacggtgcggccgtacttgaggtcgccgaccagcgcgatgtgcgcgccgtcgacgatcttgccgagccgcgagaactcgcgctggatcgtatagagatccagcagcgcctgactcgggtgctcgccggggccgtcgccgccgttgatcacgggcaggttggtcgcgcgcgcgaactcggccaccgagcctttctccgggtggcggatcacgagtgcatcgacgtagccggccatcacgcggctcgtgtcgtagatcgattcacccttggccatcgacgagaacgtgaaacccgtcgtgtcgcacaccgagccgccgagccggcagaaggcggcgccgaacgacacgcgcgtgcgcgtgctggcttcgaagaacaggttgccgagcacggcgccttccaggacgcgcgaaatcttgtggcggcgtgcgatcggctgcatcacgtcggccacgcgaaacagcgcctcgaccgactcccgcgagaactggtcgaccgacagcagctgcggcttgccttcgaaaaagaactgcttggcgagcccttgattatctacgctttgcgtatagccaccgccttccggtgccgagcgctcgacgatttccgacacgaagcgctcgacgatctcggcatcccgcgcgattcctgcgaatcgtcgggcagcagccaggtgtccagcgcgcgccggctgacgccgatgcgattggcgaacgcttcgcgggtcatgttgaggcggcgcatcgcgtcgcggaggaaggcttgctggggaacggtcatcggcggctcctgacggaaaatatacgcggtgcgtatattagttcctggcgcgttgaagtcaaggaaaatctgcgcgaaccggctgtgtggcccatgtgacatgcggcgggttcgtagtggcgcgtcgcggccgtctccgtataatcaggtcaggccccgtgcccggcgtcttgccgggcaccgcgccgcatacgattcgcccgtcgggcttgttgattcgaaggagaatgagaatgacgcgtacgattgctgcaatgctgctggtggtgaccgccgcgctcgccggttgcaatactgtcgccggcgtgggccaggatatttcgaagggtggccaggcgatcagcgatacggctgaaaaggccaagtaagccggccggtttcggaatgcagaaagcgccgggccgtcccgcgattgcggggcggcccggcgctttcggcccgtgacgacgccggcgacgccggcggcgtcacgcgtgttcgacgaacgcgtagcggccttcgaccttgcgcggcgtgaaccagccgtagtcggggaacatccggttgcgtacgtaccagacgtagcccaccagcaacgcggtgatcacgagactaggcagcgcggtcgacggatcgcgtccgagctcggcgatggtcttcggcaactgcagcagcgacagcaggatgaacgcgtgataggcgccgacgcgatgggtcgcgaagccccagatgaacagcagcgacagcggcacggtcaacgtcaggaacacggccacgaggccggtgccggcgccgcttgcgaagaagtaatacgcgagcacgaggctgatcgccagctgggcgataccgagcgcgaccaggatccggacgtgcaccttgttcttgcggcagcgctcggggtcggggcgcgatgcgatcaggtgcgcgagcacgcgatccttgagcccctgtccggacagttcggccagtgcgtcggccttcctcgttcccgcggagagcagcaccgcgattcttgttttggcttccttcctgttcattgcgtgtcggattgttgttcgatggttgtcaaagggccggccacgcgaatattgcatcttgcggggtggtgcgcaatcgatttgcggcacgcggacacattcctacagtggccggggcgcgggccaaagcgatgtgatgagaggaagtggccgccgttgccgcaatcccgcgatgaccgccgtcagtcggcggcggtttgagcggggtgggcgcggggctggccggccgggcatcgtgcgtgtcggcgagccgctcgcgccgccgcgtcgcgccgacgagcatgcccgcgacgacgagcgcgatgccggcgacccgcgtgacgttcaacgtttcaccgaacagcgcgaccgcgaacagcacggccgagaccggcgcgaccgccgtgaacagcgcggcctcggttccgctggtgcgcgccgaacccgcgtaccagcacaggtagccgagcacggtcggcaccagcgcgtagtaggcgattgccgacacggcgccgacagtccagccgtctgcgaccgcgtgccattcgaatacagccggcacgagcgcgaggacgaagccgaggcccgacatcgcggtggacagcgcgagcggcggcagcggcgcggcaaggcgccggttgagcaggatgaatacggcttcgcatgcgacggcggccagcaccagtgcatcgccggcaagcgtccggagcgacggcagcgcgtggccgggggcgaacgtgacgaacagcacgccggccgtggcgagcgcggcggccgcccagtcgcgcggcgtctgccgctcgcgcagcacgacggctgcgatcagtgtcgacatcgcgggcagtgtgccgagcatcacgcctgcgtcgagcggcgacgacagcttcgtgccgctgatcagcagcaccgtataaccgacgccgcccgccgcagcctggatgacgagcagcacgccgtcgcgggtggaaatgcgcggccagcgcattcgctgcgcgcgcatcagcgcgaacagcagcggtgtcgcgatcaggaagcgcagcgcggtggccgagaacggcggcaggccgcctgccgcgagacggctcgcgatgacggtgctgccgacgcccgccattgcggcggcgagatagagatagccgatcagtcgtgtcttcatgcgccgcatcgtcgcgtatggcggcgtcgcgtgtcttgaacgaaattgcagcgggcgcggacgcgtcgagggcagtgcgtggggcgttgcgcgtgtgcgttcgcgcagactgctgtcgaagccgaagccgaagccgaagccgaagccgaagccgaagccgaagcccaagcccaagcccaagcccaagcccaagcccaagcccaagcccaaccccaagccgcgccagccgtcgtcgacgtggggcccgccttcgatcgccttgcgaccgatcgcgttgcgcggggacgcagggcatcaaccggcctgcgtaaacctcccaggcgtgatcccgaactggcgcgcgaacgcacgcgtcaggtggctctgatcggcaaagccggcttcggccgcggcatcggcgatcggcaggccgctggcgagcagcgcgcgtgccagccgcgcacgcgactggatcaggtaggcgtgcggtgtgatgccgagttcacgggcaaacccgcgcagcagctggaagcggctcacgccgctcaggccggccagctcggcgagcgaaacggggcggccggtgccgcgtcgagccgctcccgcgcgatgcggatcgccggtgcaacgcccgccgtcggcagcgtgcggttcgcgtgccgggcgagcagcccggcgacgagcatcacgagtgcctcgtcgcgggcaagcggccgggattccccgcgacgatgcgcgcatggagccggccgacggcggccgtgagccgcgcgtcgcgcaccgccggatgcgccagctcgatgccgccgaggccttcttccgccgcgacgcccgcgaccagcgcgggcgcgaggtacagcatccgccagcgccggcccgtgccggcctcgatcggcgaaccgtcatgcatctcgcccgggttgaccatgatcgcgtcgccggccagggcgtcgacctgcccgcggccgctccacgaccggtgcgcgccgctgacgatcacgccgaccccgaattcgtcgtgcgcgtggcgcggaaacgcgcggtcggattcgaggctgattgcctcgatgccttcgccggtccgtcggtagtgggtgacgcggtgcatgtgcgctcctcgcgccggtcgcggcgcggatttcgtgcactttagcgcgttccggcgccgcgcgcccttcatcctttggccgataccgcgcatcgcgcgcagcccgcaccatgtgcacatgagcagcgtacacggcccgccgggcctgaagctgcgcgggagacggcaggtggaacgacaggatccggtattcattcaggttggcgcgctcgcggacggcttcgcgccggaagcgaacatcctcgcatcctccgatgcgctcactgggcatacgctgacgctcggcgacgcgtcgggggcatggcgggtctacacgttcgagccgggcgcgctgcagtggcgcgacgcggcgaccggcacgagcggccgagagccgtgccgcgtgacgcggttgcgcaacgggctgtacttcgtcgactacatcgattcggccgcccgcgcgacgtcggtcagtctcgtgatcgatctcgacaacggtgtatggacgtcggtcgtcggcacgctgccgaccgaagccgacacgcgtatcgacgcattcacgcgggttgcgcgcgggctgccgctgacgggcgtcgaggccggtttccggcacggcacgctcgccggccatacgcagccggggccgctgcacgggcccacgcgcgagctgatcggtaagcggacgatgtaccgctacagcccgaccgaatgctacgagcacatctatctgaacgagaacttctacgcgtggcagtgcctgcagggtgtcgaaggcgggctggccgatgtcgaccgctgccattacttcaggattgcagaggagctgtatctgttcgtgtggcgcgaaaggtggtgccgacgctcggcgtcgtgctgatcgacctcgcgcagcgcaagacagacggcaagatcttcggctaccagggcggcgatttcggcacgctgtcgaacttcccgatcggcgcgcatgcgcaggtgctgaacgacaccgtgcatccgctcgacggcggggcgcagcgatgaatgccgtgccgggcagcggccgcctgcgggcggatttcagcgggcgcgtcgtgctcgtcacgggcgccgcgcagggatcggcgcggcgatcgcgcgccgtttcgcggaatccgacgcattcgtcgcgctcgccgacctgaacggcgaggccgccgccgcgcaggccgacgcgctcgcgagcgcgggcggcgaggcgcgcgcctatcgggtggatgcggccagccgcgaccaactgggcgagctggtcgcggcagtcgagcgcgatggcggccggctcgatgtcgtcgtccacaatgccgcgtattttccgctgacgccgttcacgcagatcgacgagccgacgctcgaccggacgctgtcggtcaacctgtcggcgctgttctggctcgcacaggccgcgttgccggccttcgggcgcgcgggggcggggcggctgctcgtcacgtcgtcggtgacggggccgcgcgtcgtgtatccggggctcgcgcattacgcggcgtcgaaggccggcgtgaacggcttcattcgcgcggcggcgctggagctcgcacgccacaacgtgacggtgaatggtgtcgaaccgggaatgatccgcacgccggcggcaggcaatcttggcgatgcgtcggtcgccgcgcagatcgcgcgcgacattccgcttgcgcggatgggtgagccggaggatatcgcgaacgcgatgctgtttctcgcgtcggccgatgccgcgtacatcacggggcagacgatcgtcgtcgacggcggtgcgacgttgcccgagagcggggcggtgctgggcggcgagtgacggctggccgggtaacgcgccgcgcaacgggcggctccggcggcctgccgcgcgttcacgcagcaggctcggcatgttccgtcgggggcatcttcgcgagcgtcagtccggcatgccgtcatggtccccgagcggcctggcgggccagtccacccagcggtccgcgcgggtaagctcgtacgcctcgttcttcgggtagcggatgcggttgtcgtcgcgcgggcgttcgccgatcaccatcagcctgacctcgtccttcgtgttgttgatgaaggtgtgacagatgccggtgcccgccggaaacgcgacggaatcgccttcggcaacggggtgcagcacgccgtcgatccagacatcgggcttgccctcgagcacgtacacaaactcctgctcggtgctttcggcatgcggatatgacgtccgccgacccggcaggagcctcacgtgatgaatgccgatacgggtgatgccgagttcggcggaaagcggtgcgtccagcgccatcggctcggtgtcgccgcgatagcaatgcgcttccggttcttcgagctcggtccagtgcttgatgaaatcggggcgggtcattgggtgctctcctttcggggatgtcgactgcggcgattcacgcgccggcgtcggcagcggtttgcgctccgtctcggcgaatggacctccgccgataacttgccggccgatgcgaaacgacggttgcgcgtcgcggctgccgggcggcgggatgtgggccggatgtcgccggcgaagcgatcggcgacatccacggtattttgcgacgaaccggtttgcattgtggaaatgacgtgcgagacgcgcgcatgcctcccgccgcgtaccgccgcgactacagccagccgttgcggatgaactcgacgatcgaatagcggcggtgctcgagatcgtgctgccggacggcatcgacgatgcgcgatacgccatccgcgtagggcgtatcgcccaccacgcgcgattcgaactgcaggctgcacgcaccgtcgtcgatgcgtatccggtgaatcgcgtggcggccgagttgatcgtcggcgacggcgaattcgctgcgctgcacgtccgggtcgcgcacggagcggatgtcttccggcggcacgccgagcgactggccgatcccgacggccgtgcccgggacggacgtcttgccggcctggtgcgactccgtcaggctgatccggcagtcgtgaaacaggtggccgctggtttccagcatgctcatgaacttgagcatcaggatgttcgtgttcggacacagcacgaccgggaacgcgtacgcgccggtttcgaggacggagccggtggacagctcgacgagcggcgacgcggtggcctcgcagaacgcgatgacgtcagggagttcgcggccggaaccggcatgcacgacgatcgagcgggcgtcgacatgccgggcgtcgctacgctgcgcatcgttgtgcgtgctgtccgaccacgcgatcacgcgacaggttgcggggtcgagccggtgcgcgccgagcagttcgctggccagcttgccggttcctacgacgagtacttgcatggcattgacgggttgaggttcggaattcgttcaggacgggaaatggcgccggctgtcgggcggcccggcacggtcgcggcgcgtgccgccgcagcggcctcgcgcattatgcccggccgcccgcgtgcgcgcccgccgggccgcgcaggcggcgtgcggtgcgtcagctcgccgacaccgtcggcagccacgcgttcgccgcattctgcgtggcgagctgcttcgcgatcgagcgcgcgagtcgatccgtatcggacgccaccgtgtcgtgcttcgctttggacacgccatgcaggccggcgccgaccgctggcctgcgtgcgggccgccggcgcggcggtcatggcggtagtcgcggtcgatgcgcagccgcgcaccgcgtgcaccatgcgtcgaacctcgactatctcgatgcgaactacggcggcgtgctgatcgtgttcgaccggctgttcggcacctatgtcgccgagcgcgccgacgagccgtgccgtttcggcctcgtcacgccgacccgctcgcgcaatccgttcgtcgtcgaactcgaacactgggcgagcctcgcccgcgacgtcgcgacggcccgcgacgcgtggacggcgatccgcttcgtgctgctgccgccgggctggcgcccggacaaccagggcgaaacgacggaggaactgcgccgccgcagcctcgtcgccgtgcgcacggatgcgtgaacgcgctacgctgtgtcgaattgccggccgcgcatgcgtgccgcggccggcatgacccatgcaatacgcatcatcaagcaaccctcgatccaggagaaaacatcgatggaacacgatctcaaaggcaaggcagtcgcgatcacgggcggattcggccatctgggcatcgcgacggccgcgtggctcggcgcgcgcggcgcacgcgtcgcactgatcggccgcggcgcggccccggcggcagaggtactgcccggcgtgccggccgacgcgctgcgcatcggcggcatcgatctggtcgatccgcaggccgccgcgcgggcgctcgataccgtgcagcgcgaattcggccgggtcgacgcgctgctgaacatcgcgggcgcgttcgtgtggcagacgatcgccgacggcgacgccgccacgtgggaccgcatgtacgaactgaacgtgaagaccgcgctgaacgcatcgaagggcgcgctgccgcacctgctggcgagcccggccgggcgtatcgtcaacatcggcgcgggcgcggcgttcaaggccggcgcgggaatgggcgcctatgcggccgcgaaggccggcgtcgcgcggctcaccgaggcgctggcggccgaactgctcgaccgtggcgtgacggtgaacgcgatcctgccgagcatcatcgatacgccgccgaaccgcgcggacatgccggacgcggatttcacgcgctgggtgcggccggaacagatcgcggcgacgatcgggttcctgctgtcggccgacgcgcaggcgatcaccggcgcgtcgatcccggtgaccggccgcgtcgcatagtccggcgggcacgggctcgcgctcgcgcggcggccggccgtgcgtacaatggcgcaccggacatacgcgagcccagcccgagaccatgcatcagccccatatcctgatcgtcgaagatgaagtggcgatcgcggacacgatcgtctacgccctcggcaccgacggcatgcagaccgtccactgcaccctcgggcaggcggcgctcgaccgcctgcgcgatgcgcgcttcgacctcgtcgtgctcgacgtcggcctgccggacctcagcggcttcgaggtatgccggcggctgcgcacgttctccgacgtgccggtgatcttcctcacggcgcggcacgacgaaatcgaccggatcgtcgggctcgagatcggtgccgacgattacgtggtcaagccgttttcgccacgcgagctggcggcccgggtgcgcgtgatcctgcggcgtttccaccgggcggccgcccccgaatcgatacccgcgcccgcgccggcacccgccgcgacgaccgcgccgggcttcacggtcgataccgatggcgcgcgcgtgtcgtggctcggccacgcactggatctcacgcgctacgaattcgggctgctggcgctgttggtccggcatcccgggcgcatctattcgcgcgagcagttgatggatctcgtgtggcacgaggccttcgattcggccgatcgcacggtcgacacgcacatcaagacgctgcgcgccaagctgcgcgcgatcgaccccgagcgcgacccgatccgcacccatcgcgggatgggttattcgctgcaaccgtaacgaccggcaccgcccatgcatatcggcctgcgtatcttcttcggctttttcctgatcgtcgggctggccgcgctgatcacgctgcgcgtgttcgtgcaggaggtgaagcccggcgtgcgcgaggcgatggaggacaccctcgtcgataccgcgcaagtgctcgcgacgctggccgccgacgacatggccagcggccatatcgccgacggcgctttcgcgcggcagctcgcgcaacttcacgaacgcccggtcagcgcgaacgtgtggggcgtgcagaagaacgtgatcggctaccgcctctacatcaccgacgcgcacggcatcgtgcgctacgactcgaccggccgcgcgctcgggcaggactattcgcgctggaacgacgtctaccggacgctgcgcggcgaatacggcgcgcgcagcacgcgcagcgatccgaacgacgacagcagcaccgtgatgcacgtggcggcaccgatccggcgcggcaacgagatcatcggcgtgctgacgatcgcaaagccgaaccagacggtcgcgccgttcatcgcgcgcagccagcgcaagatcatgctgtacggcgcgctgctgatgggcggcgcgatcctgatcggcgtcgcgtgcacctggtggctggtgatcgggctgcgtcgcctgcagcgctatgcgcgcgcgattgcggcgggcgagcgggccgagatgccgctgcagggcgcgagcgagctggccgagctcgggcgcgcggtggaaagcatgcatcagcggctggaggaccggcagtacgtcgagacctacatccacacgctcacgcacgagatgaaaagcccgctggcggcgatcagcggcgcagccgaactgttgcaggaagacatgccggttgcgaaccgccggcgcttcaccgagaacatccgccgccaggccggccgcctcgaacagatgatccgcaagctgctcgcgctcgccgaagtcgaacagaagcagcggctgtcggtgcgcgaaccggtcgcgctgcggccggtgctcgaacagctcgtcgacgatatcgagccgcgcgcgcagcagcgcggcgtgaacctggcgatcgacgcgaacgacgcggccgacccggcggtcgtcgaaggcgatccgttcctgctgcgccaggcgctcggcaacctgctcgacaacgcgctggatttcgcgccgcggggcagcacgatccgcatcgcgctcgaacggcagccggcgggcagggcgcacgtcgcgatcgtgcgcgtcgccgatgacggccccggtgtgcccgactacgcactggcgcgcgtgttcgagcgcttctattcgctgccgcgccccgacgggcaggatcgcagcacgggcctcgggctgtgtttcgtccgcgaagtcgcgatgctgcaccgcggccaggtcgcgctcgcgaaccgcgacgaaggcggcgcgtgcgcgacgctcacactgccgtcgtcggcctgaccgcgcttcacgttcgccccacattcggcccacattcgcttcacaccggcttcaatcgcccttcaccgggccggcgcatgctggcggtacctttactccggtacctgtcggccatgaatcgagtcctgttgttcaaattcgcgatcaccgcgttgcttgcgctgctgatcctgatcccgctgcagatggtgcaaagcatcgtgcacgaacgctccgcgtatcgcatggacgcgctgcagagcatctggtcgagctatgcggggccgcagacggtgtcggggcccgtgcttgtcgtgccttacacggaagtcacgcgcgtgcgcgacgagacgcccgccggcggcgcgacgaagacgagcctgagaagcgagacgaagcgcctgctcgtgtttccgaagacgctgaacgtcgacggcacgctgacgaccagcgtccgctatcgcggtatccacaaggcactggtatacgaactgacgagccggttgaccggcacgctggcgttgccggacctgaagaagctgccgcaggcggacggccacgtgagcttcaaggtcgacaacgcctatgtcgcgatcggcatcggcgacattcgcgggctgaccgcgcaacccgacctgcgtatcggcggcgcgcgtttcgacgtggagcagggcacgcggctggacagcctgcgccagggtgtgcacgcgaacatcgacctcgcggcgctggccgaagcaggcgcgggggcgggggcggtcgtgccgttcagcatcgacctgccgctgcggggcgcggagtccgtcgcgttcgcgccggtgggcgaccagaacgatttctcgttgaagtcgacgtggccgcatccgagtttcgacggcgcgttcctgccgaacaaccgcacggtcgatgcgcgcggcttcaccggcaactggcgcgtgacgtcgttcaacacgaaggcgcgcgagcagatcgcgaccggcaacggggacagcgcgatcgaaacggcgtcggtgtcgatgatcgaacccgtgaacgtctatctgcaggccgaacgcgcaacgaagtacggcgcgctgttcgtgatgctcacgttcgcgagcttcttcatgtacgagctcgtgaagcggctgcgcattcacccgatccagtacacgctggtcggcctgtcgctcgcgttgttcttcctgctgctgctgagcctctccgaacacatcgcgttcgcgtatgcgtatctcgcggcgagcggcgcatgcatcgggctgctcggcttctacctgtcgttcgtgctgcacagcgtgaagcgcggcgcggtgttctcggcgctgctcgcggtgctgtacgcggcgctctacgggctgctgctgtcggaagacaacgcgctgatgctcggttcgctgctgctgttcgcgatcctcgccggcatcatgacgctcacgcgccgcgtcgactggtattcgctcggcgccgcgtggcaaccgttggccgacaaggcggccgcgggcgccgtgaagccgggcgcgcaggcgaagtaggcacgcgggtggcgagcgcgccggtcggcaatgcgacggccggcgcgtcatccggcgcgggacagccgcgcttcacgcgtgcggtgcgggccggcgaaaacgcgcgagcggaatttcggcgacggcggtgatctcgatcagcaggtcgggatggtagagacgttcgacctggacggtcgtcgtcaccggatagggcgcggcgaaatacgtgttgcggatgtcgccggcctgcatgaaggcatcgatgtcggtcgcgtagtggacgagcgagatcacgtcctgcatctgcccgcccatcgcggcgagcacggcgcggatgttgtcgagcgtctgccgcacctgcatgcgcatgtcgccgtggccgaccacctggccgtcgcggtcgagcgccacttgccccttcagatgcacgatccggccgtcgccctggatcacggccatcgagaacgcgccgaacggcgcccagacttccggcggattcactgcttcggccatcacgcggctcctgtgggcggcggctgcacggttcgcggcgagcggccgcgcaacggaggcgcgccgtcgacagcaccgcccgcttcgtcgacaatcgcgccattatggatgaacgcgcggcgacgcatggggcgttgtttcgcgatcacgacgacacacatggacgatatccgcgtcatcaaggatcgtgcggcgctcgacggcaccgcgtacgtcgaactcatgggcgggccgtatgcgcgcacctgctggaatgccgggtcgctgttcttcgacgaggaagtgttcgggctgctcgaggcggcaatcgcgcggcagatccccgactacgaccattacacgttcaacgccgtcggcatggccgactggcttgcgatcgtcgccgaactggccgacacgggcaggcggctcggcaacgccgcgcagcgcaccgccgcgctcgaccggctcggtttcattttcagcggatcgcggcaggctttcgtcgctcgtctcgacgcaagctgcgccgcgctggccggcgtgatcgcggaagtcgacgcgtggacacgcgacgttcggcttcgccacgaccaggtgacgatcctcgggatgtgacgcggcgcgtgccggctgtcaccaccgacaggccgggcggcatccacttatactcgagcttttccgccattcgattgtcgccgtgcccacgcctgcccccaccgatccgtccatcgacgatccgcgtccgaccccgcccgtacaacccgaactggaagactgctgcaacagcggctgttcgccgtgcgttttcgacttgtacgacgaagcactggcgcgctatcgcgtcgaactggccgagtgggaagcgcggcacgcgcagcccaagccatgacgacacgcccgatgccggcgagcggtgcgcacgtgccgcgcgtctcgagccgcgccggcagtgggcgccggttccgcgtcacgcgcccgcatgcagccgacgatgcagcggcccgagcatggccgacagcgcgatgcacgcgagcagcacggccgtcagcgcgaacatcgacgttctgaagccctgcacataatcgagcgcggccggatgcgcgccgagccgggcgaagaacacgccgccgagcgtcgccgcgccgacggccgcgccgatctgcagcatcgcggtgaccatgccggatgccacgcccgcgcgggcggtatcgacttccgcgagcacgatccgcacgaccgacggcagcacgaggccctgtccgacaccgatcgccgcgatccccacgtagaagccggggcccggcgcggccgcaccggcgagcgcggcggccgtcgcgacgccggccgcgagcatcgcgaaaccgagcgtgagcacgcgatagccgccgaaccggccgacgagccgcggcatcagcagtgggctcgacaggaagccgagcccgagcggcaggatcgcgagccccgatgcgagcggcgaccagttcaggcagccctgcagatagatcccgtagctcaggaagaacgcgctcagcgtatagaacaggaacgccagcacgagcccgagtgcgacgaccgggttccggaacaggcgcacgtcgagcagcggatcgtggccgctcgcgagacggcgcgcctcgaccgccagcagcgcgccgagcatcggcagcgcgccgacgaggcacgcgaccatccacagcggccagccggcctcgcgcccgtgcgtgagcgggtagacgagcatcagcaggaacagcgacagcagggccatgccgggcacgtcgatgcgctggcgcgcggcggccggctttccgggatgaagcgccagctgccgatcagcgccaggatgccgatcggcagattgacgaggaagatcgcgcgccagccgagcccgaacggatgcaggctgatcagcgcaccgccgccgagctggccgatcacggccgcaaggccgaacacgaaaccgtagaagcccattacgcgcacctgctcctgcgggctgaacacgctgcggatcgtcgcgagcacctgcggcgcgaggatcgcggcgaacaggccctgcagcacgcggccgccgaccagcaccgcgccgctgccggcgagcccgcacagcgtcgacgcgacgacgaagccggccatcccgatcatgaacatgcgcttgcggccgtacaggtcgccgagccggccgccggtgatctgcacgacggcgttcgcgcacgcgtacgccgacacgacgagctgcagctcggccgggcgcgcgccgatgccgtcgcggatggccggtagcgccagattcacaatgaagtagtcgagcggcggcaaaatcgcgccaaccagcaggaccaccagcgcccagccgtggtggctgcgcggtgtcgccgcggcggccgtgccggccgggccgcagggggcaagggtgtcgtgggtcatggaaaccagtccgaagaaacgagggccgtatccaggccggacgcggcgccgggggcgccggttcggccggggcgggcgattgaccccattctgggtggtggcaatgaatcggaaaagcgggaattggtggtagcatccatcgggttattcgatggatggagaagggcgatgcgcggtttcgacctggatcagttgcgtactttcgcggcggtcgcggatgccggcagcctgacggccgccgcgccgctgctgcacctgtcgcagtcgacggtcagcgagcaggtgcgcaagctcgaatcgcgcgccggcgtgccgctgttcgtgcgcagcaagcgcggcgtcgagccgaccccggccggctcgcggctgctgcagcacgcgcggcgcatcgtcgcgctgaacgaggccgcgttcgacgaagtgcgcgggcaggcgatcaagggcgagctgcgcgtcgcgatcaccgattactaccggacgaacgaagtcgcgggcctgctggcccggctgcgggagtgctacccgcaactgagcctgcacgtcagcgcgatgaagagcgcggatatcgaggcggcgcatgcgcgggggcaggtcgatctcggcgtggtgatgaacctgtcgagcgggccgttccggccggcgtcggccgatacgcgctgggtgctgcggcgcgagccgctgtcgtgggtcgcgtcgcccgcactcgccgagcaactgcccgagccgttgccgctcgtgctgctgccggacgactgcatgatgcatcaggtcgcggtgcgcgcgctcgacgagcggcatacgccgtaccggctcgtgcacagcgcgtcgggggtcgcggggctgcagtcgatgctggcggcggggctcggtgtgggctgtctgtgcgcgtcggcgatcggcgagggcacgatgcggctcggcgcgaaataccgtctgccgccgctgcccgacgcggtgttttcgctgacgccgccgatgccgggcgaacgcgaaaccgtcacgcaggcgcgcgaggtgctgtcgcggcaattgctgatgtagaaccgtggaaccgggccgcgcgatgcgcggcggcgcgtacctgagaggcgtgccaggagaaaaaaatgaacgacgaactgcaacgccagatggccgcgaagctgcaggatgcgctggagcgcgtggtcgacgaacgctcgctgatccacttcctgcgcgtgctcggccacgactggaacaaggagcggcagctcgaggccgacctgcctgcgtcgccgtatgcgcgcgccgcgctcggctgggaaaaccactcgatcggcgagtacctggacgcgatggtcgactgggccgaggcatcggaggaagggctgcgctactacgacctgcccgacaatccgtggcggcgcatggcggacatcctgttcgccggtaaagctacgaatagcgccgctcgggcgattcgttcactgcacgttcgccgctgcgaatcgctcaaccgcccaaccgcccagccgtccaatcgcctattcggccggttcgccgttcacgtacgcacgcagcccgtcggccagcgcatcgaacaccgcgcggcagcgcgggctcgtgcgcaggtcctcgtgcatcacgacccaggtttccagctgcatcgcgggcccgtccggcagcacgcgcacgagccgcgcgtcccgtttcgcgagcccggtctggcagaagccgatcccgtagccggcgcggatcatcgcgagctgcgccaggttgctgtcggtgcgcagcgagaacgcgtcgcgcttccacatcggcatgccgcggcccgccgagcggatgaacggcgtgaccgtgtcgaagccgatcagcgcgtgatgcgcgagttcgtcgatcgtcgcgggcgccccgttgcgcgccaggtagtcgtcgcgcgcatacagcgcgacatcgatttcgccgatgcgccgcgccacgagcgcctcctgcgcgggcggcgccatccggatcgcgatgtcggcctcgcgcttgagcacgtcctggatgcggtcggtcggcaccagctcgatgacgagccccggatggttgcgccgcaattgcgcgagaaccggcgggagcacttcgacggcgatcacgtcgctggccgagatccgcacgatgccgcgcacgccggcgccgtggctcgcggccgcccgctcgaacgcggcggccgcgctgcgcagcgcctccgcatggccgcgcagcgcgagcgccgcctcggtcggcagcaggccggacggcgagcgcgtgaacagcgtctggccgaacgcggcttcgagtgccgcgacgtggcggccggccgtcggctgcgtgatgccgagcgcccgcgccgcgccggacagcgagccttccgtcagcacggccaggaaggtgcggtagcgttcccagttcagatcggtggtcatgcataaatgtatagctgatccattgggttcggcaattccttgatagcctccggcgcgccagaatgcgtgtcatgacggttcattcaaggagagcggcaatgacgaaccacgcaggcgggacgcaacggcaggcactcgtgctcggtgcaagcggcgggattggcggggaagtcgcgcggcagctgcgcgatgcgggctggcaggtgcgcgcgctgaagcgcgggctcgacgccgaggccgtggagcgcgacggcatcgcatggatgcgcggcgacgcgatggaccgcgacgcggtcgtccgggccgcgcgcgggtgcagtgtgatcgtgcacgcggtgaatccgcccggctaccggaactgggccgggcaggtgctgccgatgatcgacaacacgatcgcggcggcgcgggcggagcaggctaccgtcgtgctgccgggcacggtgtacaactacggcgccgacgcgtttccggtgctgcacgaagatgcgccgcagcacccgtcgacgcgcaagggcgcgatccgcgtcgagctggagcgccggctgcaggatgcggccgcgcatggcgttcgcacgatcatcgtgcgagcaggcgatttcttcgggccgaagctcaccggcaacagctggtttgcggcggggctcgtcaaggccgggcagccggttgcggccatcagcgtgccggggcgggacggcgtcgggcatcagtggtcgtatgtaccggatgccgcgcgcacgatggtcgagctgatcgagcggcgcgacacgctcgaaccgttcgcgcgctttcacctcggcgggcactgggacgcggacggcacgcagatggcggaggccgtgcgccgcgttgcgcagcggcacgggctgcgtccgacgatgcgcaagttcccgtggtggttcgtgtgggtcgcggcgccgttcgtcacgacgctgcgcgaattgctcgagatgcgctacctgtggcgcgagccgatccggctggacaacacgcgggtgaccgcggtgctcggccgcgagccggtcacgccgctcgataccgcgatcgaggcgacgctggcggggctcgggtgtctcaagtgagcaacggggcgcgcggacgcaatcgcgttctgctatgatccgcgctcccttcctcgacgctgctgcaggaaggtacccacgaccgccggaatgccggaggtcgcgtcgtacctttttcattttcagcagcgatgtctacctttcctcgcttaaaaaggccttgcaacggcaaggcatccgtgtcgaccatcacgccggcatctatcacctgcgcaatgaactggcgcaggcgtccgtcctgttgcccgcttcgctcccgctcgaggagaaggccgtccagcagttgctcgcgttcgcggccgtccgttcgccggatggccatcagcgtgtatgcaaggcctgcgcgacgccggactttcatccgggcggggtcgcgcccgtcggctcgatcgtcgcgaccgacgacgcgttcgtgattcccgccgcgatcggcaccgatatcaactgcgggatgcgtctcgttaccacgggcctcaagcgctcggcgctcgcgccgttcgagacggcgctcgtcgaacggctgacgcgcgcgattcttgcggaccggcgcgacgtgccggtcggcagcgatgccttccgcgcgctgttcgacgcgggcccggcggcattcgtcgatcgtgtcgcgccgcagggctctgggcgcacgtcgaccgcgaccggcttatcgacgaactgtcgtcgtgcatcggcctcgaccggttcgacggcagcgcgaaatacgcgcccgacgcgcacgtcgggtcgcgcgaggtgttccgcgacccttgcctcggcaccccgggctcgggcaatcatttcgtcgaactgcaggtggtcgacgccgtgttcgaccggcatgcggcctaccgggcgggactcgcgaaggacgacgtcgtcgtgatgatccacagcggttcgcgcgatgtcggcttctatgtcgggcgacgctggatggaccgggcgcgcgcggcatggccggcgggcgtcaggcatccggaaagcggcctgtacggcctttccggcgagctggcgcgcgactatctcgtcgcgatgggcaccgccgcgcgttatgcgtggctcaaccgcgtcgtgcttgccgagatggttcgcaaggaactggcggagctcaccggcgagacccgctcggcactcgtggtcgacgtgccgcacaacgtcgtgctgcgcgaaaacgggatgaacatccatcgcaaggggcgaccctgcccgcgacggcgatctcgcgctgattcccggatcgatgggcgatgcgtcgtttctcgcgaccgggctcggccatccggactggctgtggtcgtgcagccacggcgccggccgcagcgtgcgccggcaggcggtgcggcggatgcgcgcggagcaggcgccgggcacgtggcgctgtgtgacgttgcgcgacgagcgccgcatcgaggaagcgccggaagcctacaagccgatcgggcccgtgatcgacgcgcaggagcaggccggcctcattcgcagcgcggtccggttgaagccgtgggtcacgttcaaggcatgacgggcggcggcggcgcgcgccggccggccgccgccgcggccggggccggtgatacgtcgtccgctttcccgggccgcggttttgcccgggcatgggtatgagcacgggaaagcgtcccggtgaaccgacgaacccgcggggcaacaattctccacatacccgggcgcatccggtgagcatcatggcggcaacgtcgataaagcgaaaccggggcgcaatgctgcatttcggatggaaagtgtcggtcgcgggggcaatcatgttcgcgttgagcgggtgcaccaacctggtgggtgtgctgtattgcgacaactcgcaggtcaacttcccggactatcactgctttcagccgtactagccggggcgggcgcggcgacggagcgccggcccgtcacgcgacgaccggcagcacctccaccgcataacggtgccgaaggctgcgcccgagcaccggatcgtgcagttccatttcgaacgcatcgccgtcgcccatcgccgcgatcgcgccatgcacggcgaccgtgccgccatacatcgcgcagcgcgcgggcatcgcgcggcgatcgtcgaagcgatgccacagcacgtcgggcgcgagcaggccgctgaccgcgccgtgctggtaggccgcgcgctcgccatcgcgcgggatcagccacgcacgcatctcgattgcatcccagtgatcggcaacatccgcataaagccacgcgtcgcgaccgagcggtttcgcgcacacctgcttcgacaccgcgacgccgtaggcctcgacttcgcgatccgtatggtcggagccgatggtcacgagcgtgccggccgggctgtcgaccagcacgcattcgatctcgccgcccgagcgcgcgccgagcacgccgatcgacggcgcctgcgtgagcagcgcggccgacacgcgatagaagcagggcgtggtcgacggcggcgcaacgccgagcgccgcgagttcgtcgatatgcgcgcggatcgccgccggatcgcggccggcccagccggcgatcacgacgcgctcgatctcgacgtcgacggtggccggtgcgggtcgccgggaaatcacgttgaacgacagggtttgcatgcgggtttccgtttgaagtccgaaggaaggaagcgactctcggcgaggttcaatccgcgagcggccggtgcgcggtttcgcgcgcgacgaggagcgcgatcgacgtgacgacgagcgcggcggcgacgtacagcgacacggccgtcgtcgtgccggtctgccggaacagcgtggcgatcacgagcggcgcgaagccgccgccgacgatgccggcgagcgtgtacgcgagcgacgagcccgcatagcgcacgcgggtcgggaactgctcggtcacgaacgcgccctgcgggccgtacatcaccgcgtggatcacgaggccgatcgcgacggccgcgacgatcgcgcccgggcgcgccgaatcgagcatcgcgaagaacacgaacgcccacacgatcccggcgagcgcgccggcgagatagacgggccggcggccgaagcgatccgacagcgcgccgaagaacggcaccgcgagtgcgttgcaggccgtgccgatcatcacggccgtcagggcgacggggcgcgacaggtgcagcacggtcgtcacgtaggtcagcgtgaacacgacgatcagcgcatacagcacgtccgaaccgattcgcgaaccgccggcgatcagcaggcgcttccagtggtacttcagcacgtccgcgaccggcacctcggcggtcgcgtgcgattcggcgagctgttcgaactgcggcgtttcatcgacgccgcggcgcagccagaaaccgaacacgacgagcagcgcgctggccgcgaacggcacgcgccagccccacgacaggaagtccccggacgtggtcgacagcgtcacgagcgcgatgcagccggtgccgagcagcgtgccgaacgacgggccgatctgcgtccacgatgcggacaacccgcgccgcttctggtcgccgtgctcgaccgacagcagcaccgcgccggcccattcgccgccgagcgcgacgccctgcacgaagcgcagcgcgacgagcaggatcgggctcaggatgccggcctgagcataagtcggcagcgcccccatcagcgcggtcgtcacgcccatcagcacgagcgtgagcatcagcaccgcgcggcggccgatgcggtcgccgagattgccgaacacgaagccgccgagcgggcgcgacacgtagccgaccgcataggtcgagaacgcgaggatcgtgccggcgagcggatcgaccgaagggaagaacaggtggttgaagacgagcgcggcgagcgtgttgtagatcgtgaagtcgtaccactcgagtgacgtgccgatcatgctcgcggtcgcgagtcggctgttgcggacgcggcggggcgcgtgggcggcgggctgggcgagagtgctcatggtgtcgggcatgtcgtgagggaacgggatggagcgccgggccgatgcgcgggcgtgccgcgcgcatgcgatgcggtcggcgcgggcgatcaggccggcagcgcggcggcagcaggctcgatttcgacgtcgccgcgtgccgcatgcagcggcgcggcggcgcgccacagcagcgcgaaggtgcgcacgtcgtcgtgcccggcgagcgtggcggccacgcggcgcgtcgcggccgcatcgctgccttcgatcagcacgagcgcgtcggcggccgggcgggcggccgcatcggcgccgatcggcgcggacaggtcgggcgcggtgcgaaagagccgtgcggcgtggatgcccggttcgtgcagcacgtcgtcgaagcgttcgcgcaggtgcggcacgtcgatgcgatccggcggcagcacgaacagcgcgagatgcgcgccttcgccgtcgccggcctcgatcgtcagttcgccgacgcgccgctgcgtgcccgtcatgcgctcgaagttcgcgagcgaccatgcggtctgctgcgtgaacgcgcgccggtacgcgtcgccgtggaacacgtcgagcgcgtccgtcacgtacagcgcgaggtacttgcgcgggccgcgatcggtcgcgcgaaagcgccgcgcatgcgtgaagcccggaatcgcgacacgttcctgcatgtgctcgcggtcgtaccacgcgttgaaatcggcttcgtgcgcggggtcgatatccgtccagacgcaaagctggccgtgcggaagggaaaagcgggtcattgcgggttcctcgtgacgggggcgtgtcaggaaccgcagtgtcccgaagacgggccgtgcccgtccaacaagaaaacaaattcgcggtgaacaggttttcttatgagcggcgcgggcggcgtttggcggggatgtggcgggcggtgcggatggcgtcgtgcgtttcgctttcgccggtgttttggctgttgccttcgtcgcggagcgggcgggtgtggagtccgcgcgatcggccgtggtcggtgtcggtgtcaccgtcgccggcttggcgtggcttgcggcggccggcatcgcgcgcgcgacttcgctggccagttccgcgatacgcgcggccaccggcaggccctggctgcggtacgacgcgacgagcggcagcgcggggaattcgggttcgacgtcgagcagctccagcgcaccttcgtgcagctcgcgcccgatgatcgcgggcggcaacgcggccacgccgaagccgtcggcgacgaggcggatcatcgcggcgaccgacgtgatgcagttgatgctggccggccgctcgacggccgcgaacagccgttcgatcgtcgcgtgcggccccgagtggcgcgagaagctgatgatcgggaattcggccaggcgcgcgacgtcgagcggctggccgccgagcccgaggcgcgggctggccgcccagcgcaccgggaattcgcacagcggcaggttcgtgaagtcggggcccggcaccgggtcggtctgcaggatcaggtcgacgccgtcggtgctgagcaggcggatcaggtgcagcgtcgtgtcgctcgtgatctcgacgtcgaggcgcggatagcgctcgcgcagttgcgccatcagcgcgggaaaccagctatgcacgatcgattcgatcacgccgatccggatcaggcccgcgtcgctcgccgcgtcgatgtcgcgccgcatttcgccgtcgagccgcacgatccgctccgcgtacgcgagcatgcggcgcccggcgggcgtgagcgtggccgagcgcgtgttgcggtcgaacaggcgcacgtcgaacgcttcctcgagcgacgcgatgcggctcgacacggcggcctgcgtcgtgtggagtttttcggccgtgagccggaaattttccagcttcgcgagccagacgaaggtttcaagaaaccggatgttcatcgaagtccgaaacgtgaggcggtgccgggcggggcggcgggaccggtcgatggtagcggattttcggcgccgggaaacgagcgggcggcgcggtgcgcatcatggggcggacgggcggcggcgtgccggcgggcacgcacgacgcgcctggtgcaacgaagggtgacgcgggcggggcgcccgcgcgcatcagagcgtgtcgaacgcgagcgtcggcacgtcgacgaccatcgcgccgccgtccgcgacgagcgtcgcaccggtcacgaacgacgcgtccggcgatgcgaggaacgcgcacacggccgcgatctcgtccgggtcggccgcgcggcgcagcggcacgtcggcgctgacgcgcgcatacgcgccgtcgagcgtgtcgccgtgcgccgacatcagcggttccatctccgcatcggccatcggcgtgcggacccagccggggcacaccgcgttcgcccgcacgccgtgcggcccgtagtcgcgcgcgagcgaccgcgcgagcccgagcagcgcatgcttgccgaccgtgtagccgcacacgcccggcccggctgcgagcgcggcgatcgatgcgaccagcacgatgctgccgcgctgcgcgatcaggtcgggcaggcacgcgcgcgcgctcacgaacgcggtgtcgaggttcgcatgcatcgcgtcgcgccactgcgcgtcgtcggtttcgtccgcgcggccgagcccgtggccgcccgcgcatgcgacgagcgcgtcgacgcggccgacgcgttcggcgatgtgcggcaggaagcgggcccagtcggtggcgttcgcggcatcgccggcaagcgcgaggccgcccgtttcggcggccagcgcgtcgagcggcgcctggcgccggccgatcagcacgacgcggtcgccgccgcgtgcgaagcggcgcgcgcacgcggcgccgatgccggtgccggcgcctgtgattgcgatcgtgcgggggcggatgtgtcatgtcgtgctccggaaaggggtggtttccggtcactttaggcgggccggcgagcgccggtatcagccgaagggatgaacgcgggcggcatccggagcaggcggccgggagcgggcgcgggccattttgcaaaggctgacgatgtccggcgccgaatcgcactatcctccacatttttgcgataagtcacgaaagcccggcagaatagcgcgggcgagccgcgtatcgacgcgcggcgcatcggccggccgattccgtcgtgcgagcggagcggcgggccggcgatcccggcaagcaggcgttgcctctgccgaacgatcgtgccgcgaccacacaacatatcgcccggttgcgcgcccgcgcgccggccatcgacaggaacagggagggccggcaatgaggctggacgacgaaagggaaagcacgaacgtcgaggatcgccgtggtgccggcgggttcggcggcgggcggggcgcgacgatcggcatcggcacgatcgtgatcgcgttcgccgcgtcgtatttcttcgggatcgacccgcgcgtggtgctcgaaggcgcatcggcgctgcagggccgccagcagcaggcgcagcccgcgcccacgcagcggcagggcgtgccggcgaacgatccgggcgcggtgttcacgcgcaaggtgctcggcaatatcgagcgcacgtggacgggcgtgttcaatacccagctgcatgcgcaataccagccgccgacgctcgtgatgttcacgaactcgaccccgacagcatgcggcacgggccagacggcgatggggccgttctattgcccggccgaccgcaaggtgtatatcgatctcggtttctacgacgagctgcgccggcgtttcggcgcgggcggcgatttcgcgcaggcttacgtggtcgcgcacgaagtcggccatcacgtgcagaacctgctcggcatttccgacaaggtcgacgccgcgcgccggcgggcgagccaggcgcactcgaacgcgctgtcggtacggatggaactgcaggccgactgttttgccggcgtatgggcgaacaacgcgcagcgcgcgaaccagcggctgatggaacccggcgatttcgagcaggggctgaaggcggccgccgcgatcggcgacgaccggttgcagcagcaagggcagggttacgtcgtgccggagagcttcacgcacggcaccagcgaccagcgcgtgtactggctgcggcgcgggatggaatcgggcgagctgagcgcctgcgacacgttcgcgtcgaatgcgcgctgacacgcggcgcgcgcgtcgtcgcgcgcttgtgtcgtcccggctgcaccagccacaccagccaccgccgccaaaccgggacgatttgccgatttgtgctcaccggcgcttttcggcgccgataggctggcccgaacttcgattttcgagacgttcgcgccgccagccgattccaccatgccgctcccaaccgtttccgccgatccggcctccgaagactggccacgcgcgctgcgcgcgtgcgtggatgcgttcgacgcgttcgcgagcccgtccgcgatcgtgttctaccggcttgaccagagcggcgagccggccgatttcgagctgttcgggatgccggaatcgatgcatcgcacctatgtcgcgcgctaccggatgctcgatccgctgcatccgtcgcgttgcgcggcgggcgaacgcgcggtcgtcacgctcgcgtcgcaattgcctgacgaaagacgcgacgcgtccgcgtactggacccgtttcctgcggcgccacgacgtggccgacgtcgtcgagatctggctgcgcgacgcgggccggacggtcggcgcgttctcgctgttgcgcttcggggccggcgacgcgcgcggcggcgcggccggcaacgccacggccgggcggttcgcacccggtgagatcgatgcgctcgcgcggttgcagccggttgccgaagccgcgctgagcccgctgctgcgcgcgcggcgcgggatccaccggatcggctgcgaggagcggctgacctatcgcgaggagcagatcgcgcgcctcgtgcgcgacggccgctcgaacaaggagatcgcgcgcgatctcgcgctcggccagccgaccgtcaagacgcacctgatgcgcatgtaccgcaagctcggcgtgtcgaatcgcaccgaactggtgggggcgctgttcctgtaattcatcggataattgcggcccggacttcgaaccttcgcgatcgccgattcgtgaattcccacgccaagcgctgctgaccatgtacgctcgtcgtttcgataacaatcaaagggccgcgaacatggacgtcgcaatcattgccgcttcgctggtggtcatcgccttgagcattgcactaccgatcttcatcatcagaaccgtgcgaagcgggacttacgactcgctgtatttcctgatcccgcttgccctcggcatttactggctggattaccaggcatacgatttcctggcgtcgatggggcacggtttcagaaactagcctttcagtccgttcccgtaccggcttttcacctcgcctcgccgcgcccgacctcccgcgcggttcgaccccgccgccttctccccacgcgctgccaatttgcgctcaccgggcgtgaaccctcgtcgatacagtggtccgacgcccgcgtgcatcacacgcacgcggtccagccacgacaatcctcgagacgcccatgagcaccacgaccttcgtcgccgtcagcgacaccgtgcgcactttcgttgcgcgcgatttcggcctcttcatcgacggcgaaatgcagcccgcccacgcggccgcgcgactcgacgtgtacgaccccgcgacgggcgagcggctcgcgacggtcgcggacgccgacgaacgcgacgtcgaccgcgcggtcgccagcgcgaagcacgcgttcgacacccgcgtgtggagcggcctgcgtccgtccgaccgcgaacgcatcctgctgaaactcgccgacctgatcgaggccgacgccgaaacgctcgcgcagctcgaaacgctgaaccagggcaagtcgattcacgtgtcgcgcgcgatcgaggtcggcgcgagcgtcgaatacgtgcgctacatggccggctgggcgaccaagatcaccggccagacgctcgacgtgtcgatcccgtttccgcccggcgcgcgttatacggcctatacgcgcaaggagccggtcggcgtggtcgccgcgatcgtgccgtggaatttcccgctgatgatcgcggtgtggaagctgatccccgcgctcgcggccggctgcacgatcgtgctgaagccgtcgccggaaacgccgctcaccgcgctgcgcctggccgagctcgcacgcgaagccggcgtgccgcccggcgtgttcaacgtcgtcaccggcggccgcgtgtgcggcgccgcgctcgcgagccacccgtcgatcgcgaagatctcgttcacgggctcgaccgcgaccggcaagctggtcggcgcggcagccgtgcagaacatgacgcgcttctcgctcgagctcggcggcaagaacccgatcgtgatgctcgacgacgtcgacgtcgcgcaggcgctcgacggcgtcgccgccggcgcgttcttcaaccaggggcaggtgtgcgcggccgcgtcgcgcatctatgtgcaccgcagcaagttcgcgcagcttgccgacggcctcgcaggcgtcgcgctgtcgatgaagctcggcgcgggactcgacacgaccgcgcagatcaacccgctggtctccgcgcaccatcgcgacaaggtcgtccagcacatcgagggcgcgcgccgcgcgggcctgacgttcctcgcgggcggcacgccggccgacgacctgcccggctactacgtgaagccggccgtgatcgccgatccgcatccggacagcgcgatcgtgcgcgacgaagtgttcggcccggtgatcgtcgtcgtgccgttcgacgacgcggccgacgcggtgcgtctcgcgaacgcgtcgccgtacggccttgccgcgagcatctggagcaacgacctgaagcgcgtgatgaacctcgtgccgcagatcgaggccggcaccgtgtgggtgaactgccatatcccgctcgatccgtcgatgccgttcggcggctacaagcaatcgggcatcggccgggagttcggccagtacgcgatcgaaggcttcaccgaaaccaaatccgtctgcatcgcgcactgacgcgcggcatcaacctcgaaccctgaaccaggacgacccaggttcaaacgatccgaccgtggagactgcaatgagctacaacgaagcaaaattctggcacccgatgctgcacccgaacgagatgaagcagcgcaagccgatccgcatcgtgcgcggcgacggctgctacgtgttcgacgaacaggggcgcaagctcgtcgacggcgtcgcgggcctgtggaacgtgaacgtcggccacaaccgccaggaagtgaaggacgcgatcgtgcgccagctcgacgagctcgaatacttccagctgttcgacgggatctcgcatccgcgcgcggaagagctgtcgaagaaggtgatcgacctgctcgaaccggaagggatgcgccgcgtgctgtacagctcgggcggctccgattcgatcgagaccgcgctgaagatcgcgcgccagtactggaaggtgcgcggccaggccgaccgcacgaagttcatctcgctgaagcagggttatcacggcacgcacttcggcggcgcgtcggtgaacggcaacacggtgttccgccgcaactacgagccgaacctgccgggctgcttccacgtcgagacgccgtggctgtaccgcaacccgttcacgcaggaccccgaagaactcggccggatctgcgcggaaatgctcgagcgcgagatccagttccagagcccggacacggtggccgcattcatcgcggagccgatccagggcgcgggcggcgtgatcgtgccgccggccaactactggccgctcgtgcgcgaggtgtgcgaccgttacggcgtcctgctgatcgccgatgaagtggtgacgggcttcggccgcagcggcagcatgttcggcagccgcggctggggcgtgcgcccggacatcatgtgtctcgcgaaggggatctcgtcgggctacgtgccgctcggcgcgacggtcgtgaacgcgcggatcgaggacgcgttcgccgcgaacgccgatttcggcggcgcgatcatgcacggctacacgtatgcgggccacccggtcgcatgtgcggccgcgatcgcgagcctcgacatcgtcgtgaaggaagacctgccggcgaatgccgcgaagcagggcgcgtatctgctcgaagcgctgcagccgttcgcggaacgcttcgcggcagtcggcgaggtgcgcggcaaggggctgatgctcgcgctcgacctcgtcgcgaacaaggacacgcgcgagccgatcgacccgctgtccggctacgcgaacgcggtcgcggaagtcgcgcgcgagaacggcgtgctggtgcgcccggtcggcacgaagatcatcctgtcgccgccgctcgtgatccagcgcgagcagctcgaccggatcgtcgacgcgctcgcggcgggcttcgaggccgtgccgttcgcgtgacggcgtgatcgcgtgacggcacgccggcggcgggcagcgcggccgccgccggtttgccgatttgcgctatgaccggattattttgcctgcgtatttttcgacatcggatcaaggtgtgatcgacaggggcccgggaatcgaagcgctgaagcgccgccccgggccgaccgcaagcatggggccccgatagctgccggagcgcaggttcgggcccgttcaggaaggagacgaagatgtcgggatggtcaggtattaccggcgccgcgggcggcgcgcccgccggcacgccggccgaggcaggcggcggcacggcgctgaaggcgggtgcggtcggctttccgaccgcgctggcgagcgccgtcggcctcatcatggcaagcccggtgattctcaccgcgacgtcgggcttcgggatgggcggctgggcgttcgcggtcgcgatgatcatcgcgttcgtgatgatgcaggcgcaggcgaccacgttctcggaagccgccgcgatgctgccgacggccggctcggtttacgattacctgtcgtgcgggctcggccgcttctgggcgatcaccggcacgatctccgcgtatttcctcgtgcacgtgttcgccggcacggcggaaacgatcctgagcggcatcatggcgctcgtcaatttcgaatcgctgaatgccgcgttcgagaagcacaacagctcgtggctcgtcggcgtcggcctcgtggtcacgttcgcgatcaccaacatcatcggcatcaaggtgttcagcaagctcgagatcgtgctgacggccggcatgtggctgtcgctgatgatcttcggcatcctcggcctcgcggccgcgccggccgtgcatctcgacggctggttcggcggctcggaagtcggcacgtcggtgccggccgtgctgtcgctcgtcgggatggcgatgttcatgttcgtcggctgcgagttcgtcacgccgctcgcgccggaaatgaaggcgccgggcaagacgattccgcgcgcgatggcgctcggcctcgtcggcgtcgcgatctgcatgttcctgtacggcgcggcgatccgccgtcaggtcgcgaacgtgcccgtgagccccgacggcctcacgcacctgctcgacacgccgggcgcgattcccgcgttcgcgctgcaggtgcttgggcccttcggccgcatctggttcggcatcgcgttcctgtgcgcgggcgccgcgacgatcaacacgctgatggccgggctgccgcgcatcctgtacgggatggcgatcgacggcgcgctgccgcgctgcttcgcgtacctgcatccgcgcttcaagacgccggtggtcggcatcgtcgcggcggcgatcgtgccgatcttccacgcgtggctgatcaacggcaatctcgacagcatcctgcacctcgtgctcgcggcgacctgcgcgtggggcaccgcgtacctgctcgtcaccgcgtcggtcgtgatgctgcggattcgccgcccggacctgccgcgcccgtaccgttcgccgctgttcccgctgccgcagatcgtgtcgagcgtcggcatcgtgctcgcgatctggtacatcacgccgccgggcatgaacgcgcgcgacatctacgtgccgttcggcgcgatgctcgggctcaccgcgctgtacgcgctgttctggacgctcgtcgtgcagcgccgtcatccgttcaagccggtgccggtggaagaagtgctgcgcaacgagcacgtcgcgtcgtgaaggctgtgctcgcccgctggcgcgcggcgcccgatgcgccgccgcccggccatcggcccggcgtgatcgccgcgcgcgtgctcgccgatctgggcgccgcgcgcgatgccgacgggggcggcggtctgacggcccggttgccgaacggcgtgcgcgtgggcatcgacgagcgtgtcgatcgccagttcctgatgcacacggtcagcgtgaaggtggcggtcaccgcatgtggcccggccgagcagggccgcgcgcgggtgacgcagaccggctggctgcgccgcacgggcatcgacgcggtggccgagccaggatgcgaccccggattcgtcgacacggtggccgcgctggtcgccgagccgtcgctggccgacgcgctgcggccgctgcacctgaccgactgcgcgatcgacgcgcgcgacggccgctggacgctcgcgatcgtgccgttcggcggcagcgaggtcgtgaaccggatgccgtcgttccgccgctacgtccgcctgacgggcgagcaggccgccgcgctgtcggcggcctgtcttgcgttcgaaaccgcactacgcaggattttgcacgggtaagctgtggcgttgcgcgccggggaacccggcggccgcgtttagggttttaccggagatgccgatgctgttccagtcacgctcacacgaagacgtgcacgatcacgggctcgcgatcgcgggctggcatcaggtctaccgccagatgacgccgggccgcttcaagggcaccgtcacgcaggtgctgtacgacgatttccacttcttccgcgagacgaccaaccggcgcgtcgcgcaaaccgggctcgcgccggccgggcgcacgtcgctcgcggtgccgctgtcggtgccgctcgcgggcacgttccagggccagcccgtcgacggctatgcgctgctcgcgctgcgcgccggcgaggatttcgaattccacacgccggaagggatggggctcgtcgggatcagcgcggcgaccgacatggtcgacgagctgtgcgaagccgaattcggcgcatccggcgcgcgcaagctgcgccacgtgacgcggctgtccgacgagcagggcgtcgcgctcggtgtgcggctgtcgtcgttgatcgacgatgcgcagcgcaaccccggccacctcgaatacgcggccacccgcaagatgtttcgcgacgcgatgctcggcatgttcctcgacgcgctcgagcagggcatcggcgtcgagcgccgcgacatcacgcacgccacctacagcgacatcgtgagccgttgcgagaagcatttgcgcgaccgccccgaggaacccgtcaccgtgctcgaactgtgccgcgcgctgcgctgcagccgccgcacgctgcagacgagctttcaacgcgtggccgacgtcacgccggtcggctatctgcgcacgatccggctgaacgcggtgcgccgcatgctgcgcacgacatccgtgcagcagctcggcgtcggcgaggccgccgcgagctgggggttcacgcacctcggttatttcgcacgcgagtatcgcgacctgttcggcgagctgccttcccagacgacgcgtcccgaatgacgcacgcgcaccgcgacgccgccgccgggcaacgtcgcgggccatgcgcgccacggtttgccgatttgcgatagaggtcctgaattttcgctggatagagtcctgtcacccatatcgacaaccccatcgatctgcactgcgtatcgatgacaacagagggcgggacatgagaatcggaagacgactggccgcggccgcggccacgctcgggtgcatgcacgcacacgcgcagacctccggcagcgtgacgctgtacggcaccgtggataccggcatcatctactcgacgaaccagcagttcacgcgcgccgacggcagcacgggcggcggccatgcgtggcagatgggcggcggcaacctcgtgccgtcgcgcttcggtttccagggggccgagccgctcggcggcgggctcgacgcggtgttcacgctcgagcagcagttcctgtccgcgaacgggcaggcgctgcagggcggcaccgcgttcagccggcaggcgtgggtcgggctgcgccaggacgggatcggcacgctcggcctcggccgccaatacgactcgtacacggacatgctcggcgcgtacgtatcgagcaacaactgggcgacgccgtacggctcgcacctcggcgacgtcgacaacctgaacgctgcattcaacttcaacaacgcggtgaagttcaccagcgccgatttcaacggcttcacgttcggcggcacgttcagcttcggcgggcaggccggcgatttctccgcgaagcgcggctatgcggtggctgcgacgtacacgcgcgcgccggtggcgttctcggtcggctacctcgacctgcaccagccgctcgacgcggcgctcggcggcgcgagcggctatatcggcgatttcgcgtgcagcaacccgggcgcgatgtactgcctgctgcaggatgccggttcgatgcgcgcgttcggtgcgggcgggtcggtcacgttcggtgcggcgacgatcgcactcacctatacgcatacacgcctcggcgacagccgctacttctcgaccgccgcgcagccgcgcacgcaggcgttcacgttcgacatcggcgaactgaacgccacgtacctgttcacgccggcgctgcagggcggcatcgcgtacatcttcaacgccgcccataccgacgggcgcggcacgacgcggttccaccaggtgaacgtcggcacgaactacagcctgtcgaagcgcacggcgctgtacgcggtcgcgatcggccagatcgcgagcgggacggggctcggcaccgacgcgaacggcaacgcggtgaactacgcgcagattccggtgctcgcgaacagcaactcgagccggcaactggcggtgatggccgggatccgcgtgaatttctgaccggggcggaggcacggagcggcaggcggggcggggcagccgggcacggcggcggccgttcccgccgcgtgccataaattcgtaacgatcggcgtgaacaatggcgttcgcttcaggcggccagaagcgtcgcccgcgttgcacacgtgtgcaacgcctggccgtcccgccaccacgccgaacgagagagacctcatgaccttgctgagccgcctgcgcgcgctgtccgccgccgttgcgctgtcccttgccgcctcgcacgccttcgcggcggatctcgtcatcgcgggccgcgacgacatctacggcaagggcctggccgacgccgtcgccggcttcaacaagctgcacccgggcaccgagatcgagctgctcaagctgccgaacgcgaacctgtaccagaagctcaagctgtcgatgcgcgaaggcaccggcgcgtacgacctcgtgatgatggacgacacgtgggcgcccgaattcatcggcaacggctggctgaagccgctgccggcatcgctcgcggacgccgacctcgtgccgtctgccgtcgcgctcggccgcaacgcggccggtgcgctgtatgcgctgccgatcgtcggcaacgtcgagatgttcgcgtaccgcaaggacctgctcgcgaaatacaagctgccgccgcgcaactgggacgacgtgctgaagatcgcgcagaccgtcggcggcgcggacaagagcgtgtcgggtgtcgtgttccgcggcacgaagggcaacccggtcgtgacgggcttcctgccgatcctgtgggcctacggcggcgacgtgttcgaccgtgccggcaacgtgacgatcgattcgcgcgaggcgcaggccgcgctgaagacctttctcgcgctgaaggcgtccgcgccgaaggacgtcgatgtctacggcgcagcggaagtgcgcgacgcgctgcagcgcggcacggccgcgcaatcgatcgaagtgtggccggcgtgggtgccggcgctcgacgatccgaagcagtcgcgcgtggtcgggcagatcgcgctgcaaccgccgcccgggcagactgccggcccggcgccgatgctcggcatctggcagatgggcattccgaaggacgcgccgcacgcgaagctcgcgcaggacttcctcgcgtatctgaccaaccgcgatacgcagacgcgcctcgccggcattggcattccgccgacccgccgcagcgtgttcaacgatccggcgctggtgcgccagtatcgctggtatccggatcagctgaaggcgctcgaggccggccgtgcgcggccgcgcgtgaaggactggcagcaggtcgagagcattctcggcgaccagcttcagctcgcgctgacggggcaggccgcgcccgacgccgcgctgcgccaggcgcagcagaagatcgcgcaggcgacggccgcggccggcaagtgacggcgcacctcgcgatgtcgtccggaacccgcgcatgaaagcctttggccgcagcctgccgttcgtcgcactgctcgggcccgcgctgctggtgctcgccgcgctcgcgctgtatccggtcgcgcaggtgctgatcgattcgttctgccacgtcgactactcggccggccgccgcgcgttcgcggggctcgcgaactatcgcgcggtgctcggtgatgacgcgttcacggccggcttcggcaacacgctgcgcttcacgatcgtcgcgtcgctcgccgaagtcgcgctgggtttcggccttgcgctgctgttcgtgcgcgcgtttccggggcggcgcatcgcgctgccgctcgcgatcctgccgatgatgctgtccacgctcgtgtgctcggcgatctggcgcaactggctcaacttcgacggcttcctgaacgcgctcctcgcggcgttcggcgtcgaaggcgtgcgctggctgtccgatccgcatctcgcgttatggtcgctcgcgctcgtcgacgtatggcagtggacgccgatggccttcctgatcgtgctggccgggttgcagtcgatcccgcaggaactgtacgaagccgcgcgcaccgacggcgcgagcgagtggcagtgcctgcgcgacatcacgctgccgctcgcggcgccgcagatcggcctcgcactgctgctgcgctcgatcgacacgttcaagctgttcgacaaggtctatgcgctgacgggcggcggccccggcaacgcgacgcagacgctgtcgacctacatctacgacacgggcttccgcttcttcaacgtcgggccggcgagcgccgcgtcggtgctgatgctcgcggcgtccgcgctgctggtctcggggtacgtatggcagacggttcgcaagcggcgcgcatgacggcgcaatccacaggcatttcgcgcgcgcgcacgggcgccgcattcggccgcgcgctgccgtgggcgctgcgcatcgccgcgctcgcgctgttgctgctgccatgcctgtggatggcaggcgcggccttcatgccgacgctcgaacgtctcgatcatccgctgcggatctggccggccgcgccgaccttcgcgcatttcgcatcggtatggtccaacggcatcggcgcgccgctcttcaattcgctgctggtcggcttcggcacgacgctcttcgcgctggcgctcgcgtttccggccgcatacgcgctcgtgcggctgcgctttccggcgcggctcgacctgctgttcctgatgctcgtgcttgcgttgaagctgatgccgccgatcacgatcgcggtgccgctgttcgcgctcgcgaaacggctgcacctgctcgattcgacgccgggcctgatgctcgcgtatcagatctatgcgctgccgatggcgatctggatgctgctcgcgttcgtgcgcgacgtgccgatcgaatacgaggaagcggcctgcatcgacggcgcggggctggctcgacggctcgtgcagatcgtgctgccgctgtgcgcgccgggcctgatcgcgacggcgatcttcgtgttcatcgccgcttggaacgaattcctgatcgcgctgctgttcgtgtcgacgccgagccgcttcacgctgccgctcgcgatcgccggctacgtgacggagaacgggatcgactggggcgacctgatgagcgcggggctgatggcgtcgctgcccacgctggccgtggccggctatgtgcagcgttacctgctgcgcgggttcgcgggcggattgaagtgacgccgatgcagggcggcggtgcgccgcgcggcaggcaccgctgcgcgctcgtgcctgtcatgcaacccgttggcgcgcgcgtgcgcatcgcacgtcgctacgccggacggccgacgcagctgtgacgaacgacgcaggtcaccggcacgacccgcgtgcgcgatgcgccggcgaacgcctgcatccgctcggcgagcatgtcgacggccgcgttcgcgaggccttgcgtatcctgacggagcgtcgtcagcgcatagccgtcgaatgcggcggcaggaatgtcgtcgaagccgatgacgcgcaagtcttccggcacgcgcagcccgaactgctggcgcgcggtgtcgatcaagcccaacgcgagcaagtcggacgagcagaacacgccgtccggaacggtgtcgccggacagcagatgccgtgccgcttcgacaccgcatgcgtatgtgtcggacggcgtgtcttgaatccgtacgcttgcagcgccatcggtatcgccgtgacggcgaagcgcttcgacgaacgcagcggcacgcgcgttcgcactgtagctcgcgttgcgcggcccgacgaacgcgacccggcgcgcgcccgcctgcgcgagcattcgcgcggcatgcgcggcgcccgccgcgttgtcgctcacgacgatatccgcgcccggcaggttcgcgtcgcggttgatcatcacgaccgggatccggtgttcgagatactgctgcgcgaccgacagcggcggcgacgcggacgtcatcacgaggcccgcgatccggtagctgagcaactgttcgagcgattgccggacctggcgcgggtcttccgcattggtcacgagcggcgtgagcgcgcgctgcccgagcgcggccatcaggtccgacagcagccgcgcgcgaaacggattctcgaacccggccgtcacgacgccgatcatgctgctgcgctgcgtgatcatgtcgcgcgcgatcaggttgacctggtagccgagcgcgcgcgcggcgatcatcacgcgctcacgggtttgcggtgcgatgctcgccgtcggcgagaatgcacgcgacaccgcggagcgcgatacgccggcgcgcgccgcgacatccgacgccgtcacccacggttttctttccttgtcattcatcgattcatgattccttcgagccacgatacgtgcacgccgcctgccgactggatgtcggcgctcgacgacgcgcggccgctgcatacgctgaccctaccgggcagccatgacacctgtgcgtatacggtcgacgatgcgctcgtgcgcacgcaacgcgcgccgctcgacgcgcagctcgcgcacggcgtgcggctgctcgacatccgctgccggcacgtgcgcgacgcgttcgacattcatcacggcggcatcgcgctcggcatgacgttcgacgacgtgctggccgattgcgtgcgttttctcgacgaacatccgcgcgaatgcatcgtgatgtcggtgaaggacgaatggccggcgcacgcgtgcacacgcagtttcgatgcgacgttcgatgcgcatcgcgcgcggcatccgcggctgcgctggcatgccggcggcacgctgcccgcgctcggcggcgtgcgcggcgcgatcgtgctgctgcggcgctttcgcagcagccggccgctcggcatcgacctgaccgcgtggcccgacaacgcgacgttcacgatcgatcatcccgacggcgcgttcgtgatccaggacgaatatcgcgtgccggtggcggcgtcgatcggctggaagtggcgtgcgatcgacgcgctgctgacggacctgccgtcgccggacagtggccgctgggcgatcaacttctgcagcgggaccggcatgggcgcgaatccgtcggtcgttgcccacggcgacggcagggtgcagggcattcatgcgcggctggccgcacggctgcgcgagcagcgcggcccgtgcggcgcgatgctgctcgatttctgcgatgacgacgattgggcgctggtgcgcgcgctgatcgcgtgcaatgaccatgcgccggtgccgggtgggtggcgcaaggcgtttcgctgttagcgaagatgggcggtgaagaatgcgagcgccttggcatcgagcatcgcgtggaatgccgcgcggtcgaatcccttcgcatcggtgcagacttcaggcgagtcgtgcgccagttgttcggggcacggcgcgagaaatgcgaagtgcgcggaattcggcacgacgtggaattccggccgtcgcggcagcaggccggccagcgcggggaccgaatccggctccacgccgtcgccgcccgcttcggacgcccagagctggatcggcgcgtgcacgtccttcagcgtttcggcggtcgggaattcgtcgagtgggtcggcgagcacgtaggccttgatcctcggatcgtgcgtcagcggttggcgcggcaggtcgtggtcgcggatctgtttgcagatcggccaggtcgggtccgggcaggccacgtgcgcatgcacgaaatccggattcgcgccggccagcacgaggcccgtatagccgccgcgcgagaagccgaagaagccgatccgtgcgggatcgacatgcgcggcatcgggcgcgttggccagcatgtagtcgatcaggcgcttgatgtccgccggccgctcggcaaattcccgcaggtcggccgcgtggctcatgtcggcatgcgtgtcgccgggatgattgatcgccgcgacgacgaagccggcgtcggcgagcgtttcggcgaggtcgtgatggccgaagtacgtgccggcgtgaccgtgcgagatcacgacgagcggcagcttgtcgccgacggtcgggcagtcgcgttgccctttcagcaggaacgggccgatcgtgagcgattgcgcgggtgtcgcgcagggcgtccagatggccgcgcgcagctcggggccggccgcgtcggccgggatgctgacgaacttgacgccggccgcgtgcgcgaccgtggcggacaggcagagcagggcagccgatagccaggctttcatggtgcatccctccgggacactgagcagactgccgttgcggatcgccggtcgggcgccggcgtgcgattgcacaggtatgaagatcagtgtgcgtcaccgatcgtgatgcagaaatgcagtcggtcggtcgttgcgtggtattcgtcgtgccacgcctgcgcgtcggacgtcatcgtgctgcggcagaacgcggcagcatccgccagcggccagtccgctagacacacggtgccctgcggtgcgctgccgtgtccgacccgcccgtcggcggtcaggacccagccttcccatccgtagatcggaatgcgatgacgcacgcaataatcgatgcattcgagcgcggcgtcgagcggaagcacgatctcgcgaccggaaatcgattgcgcggcgagagcggcaggaatcttcccgagttgcgacatggcgggcggcagggggcggtgtggcgcgggaccggcgggctaccgcgtcgcgattgccactgccgcaccggccattgcggtcgcgctcgtgcggttcgcgatgcgtttcgcgcgcgccgaagtgaaaaagcccgcgcgcgcgcgcgagcagcgaccagaagcagtcggtgaggatcagcaccgcgagcatcgtgccgacgagttcggcccacgcggtcacaccgacgtgcgtgagatcgacgatggtcggcagcagcgcgagatagaacaccatgatcttcgggttgccgagcgtgacgagcatgcctgcgacgaacatgcgcgacggcgactggccgcgcggcaggtcgtcggcgccggcctcggtcggcgcggtccacatcttccacgcgaggaacagcaggtacgcgacgccgagcagcttcagcacgatcaggccggccgcgaacgtgcgcgcgaacgcggacagccccgcgaccgcaagcgtgagccacaacgcttcgccgagccacatggcggcgaggaatggcagcacgtcgcgcacgccgttggtcagcacgcgcgcgacgagcgcggcgacgctcggcccggggtgccggcggtgacaagcagggtgacagcgaagacggcgagcgcggacaacgtcatgacgaacctcgtgggtggggcgttcgaaacgtatgaagtttcgattatagtgacggccgttccagactgcctgcctgaattgccgcaatgaccgcatcgatcctgattcgccccgccatgcgggaagacgcggccgcaatggccgccgtggaagtcgccgccgcgcagcggtttcgcgccatcggcatgacccacatcgccgaagccgagccgaccgatacggctgccgtgctcgcgcgcatcgatggcggccgcgcgtatgtggcggtcgatatgcaaggggcgtgcgtcgggttcgcgttctaccggctgctcgatgcacagcggttgtatctggaggaactggatgtcgcgccgtcgcatgccggacagcggatcggcgcgcgcctgatcgaacaggtgagcgcgcgcgccgcgcaggaaggcctcgcggaggtcgtgctgtcgacgtttcgcgatgcgccgtggaatgcgccgtattacgcgcgcctgggtttcagcatcgtcgacgatgccacgctcgacgacacgctgcgggcgatccgcgcgcaccacgtcgcgctcgggctcgacgagacgcagcgcgtgttcatgcggatgcgcgtcccgggctgacgcagtcgcggcgcgttgcggtgcgggcagcgcgaccgggtgtcagcgcaatgcccggcttccggtcaccggcagcgacgcgaacgcggcctccacgtgcgccagaaaatcggacgcgggccgcgtcagttgcaggccgggcggcgtgagccggtacaactgaagcggtggcggcgacatcggcaagggcagcggcgtcagcttctggccgaacacggtttccgcgagcgacagccgggtccacgagaaaatcgcatcgttggtcatgagcaggctgtagaacagcgcatacgacgtgcagcgcgtgatgcagcgcggcgggggcaggcccgcgtgttcatgcaggtcgcggatataggtggggaagttgtcgctggcgtcggcgtggatccattccgcgtcgcgcagcgcctcgagcgatgtcgcgcccgcgaagcgcccgttctcgcgggtgacgaacgcggtgtcgaacgtgcggatcgccctgatgtcgaccgactcggcaatggggcccgtgacggcgacgaaggcgagatcgagcgtgcgattgcgcaactgttccgtgagcaggttgaacgtcagttcccgaagttcgcattcgacgttcggccagtggcggcggaaggcggcgtaggcttccgcaaagcccgtcacggcgacgatcggcgtgaagccgatcacgagccgcccgtcacgcagccccttcatgtgcgccatgtcctcgctcgcccgttcgagctcgcgcacgacggcctgggcgcgcccgagcagtgcgtcgccttccggcgtcggcaccacgccccacggtttgcgctcgaggagcgtcacgccgaactcgttttccagttcctggatcgccttgctgatggccggctgcgtgacgtgcagggccctggccgccgccttgatgctgccggccgtcgtgaccgcgacgagtgcgcgcaattgatggattttcatgatgcggaagatattaccaaaagttatccgcatcaaaattcgtgagtttttgacccgaaacgcgtctctatgcttggccggacggtcgcgaggcggccgattccacggagccatccatgacgcagaaccttgctcacgtactcgcggcgattcgcgagtcggagtcccgattcgttgcgatccgccgcgacatccacgcccatcccgaactcggtttcgccgagacccgcaccgcgcggctcgtcgccgagcaactggccacatggggctacgacgtgacgacggggtgggaggcaccggcgtcgtcggccagttgcggcgcggcgcgtcggtgcgcacgctcggcctgcgcgccgacatggatgcgctgccgatcgaggaggcgacggggctgccgtatgcgagcacggttgcacgcacgatgcacgcatgcggtcacgacggccacacggcgatcttgctggccgccgcccactatcttgccgaacagggccgtttcgacggcacgctcaacgtgatcttccagccggccgaggaagggctcggtggcgcaaagcggatgatcgacgacggcctgttcgaacgtttcccgtgcgaacgcgtgtatgcgctgcacaacgcgccgggcgtgccggtcggccatttcgcgttgcgctacgggccgatgatggcgtcgtccgattcggtgacgatcaccgtgacgggcaaaggcgggcatggtgcgatgccgcagctcgcgagcgacccgatcgtcgcgggcgcgcaaatcgtgaccgcgctgcaatcgatcgtctcccgcaacgtcgatccgctgaagccggccgtcgtgaccgtcggcacgttccatgcgggcactgtcccgaacgtgatcccggaaacggcgacgttgcagttgtccgtgcgcgcgctcgacgcgacgacgcgcgacgaaatcgaggcgcggatccgccggatcgtcgacgcgcaggcgcaggcgttcgggatgaccgcgcagatcgaataccggtcgatctcgcgtgtcgtggacaacgaccgtgcggcgtcggatctcgcggtggagacgatcgcggcgctggccggcgaaggcgcgcttacgctgttgcccgatggcgtgatgggcagcgaggatttctcgtggatgaccgaatgcgcaccgtgttgctacgtgctggtcggcaatggcgtcgattcccggggcggatgttcggtgcacaacccgcattacgacttcaacgacagcgcgttgagctgggggcagcctatttcgccgggattgctgaacgcttcctgaagatggactgacgaaggcgcaaaggagacgcgctggccggatctgggttgacttgacgataaggaagacgaatgaaaagcgatttgcactaggcgcggcctgtctcgcgttcggcgccggcaacgcgcgcgccgtgccctatcaggacgtgttgctggcggcggtgcccgagtacaacggcaggatgacggaggagtcgcgctgtatggttcgctcgacatggggatcaactaccagacggtcggcggccgttcgctatggcagacgcagagcggcggcgagtggacctccaaattcggcttcttcggccgcgagaacctcggtggcggctggcgcgccgagttcaatctagaaagcggttttctcgcgaacagcggcgcgcagcaggatgcgcaatcgacgtacaacaggcaatcgtgggtcggcctgtcgtcggacagctacggccggttgcgtctcggcaagcagatcggcacggcgctgccgctgttcatcgacgtgttcggcacggtgggcacgaactcggtctatacgtggctgggcgcggcagccgtgcagacgagccgcggcgtcggctacaactcggacctcgggccggggcgacgcaattgccggcgcgcgtcgacaacgccatcacgtaccgtacgccgatcgtcgcgggcaccacgtcgctgatgctgatgtttgcgccgagcaacgtggccgggcgggcacccgtggcgtccgcgcaaggcgcgctgttgcagtggtacaacggcacgacctatctggccgcgagctacaaccaggtgtggggcgtcaacggggcgagcaccgtgcgcaacgacctgtacgggctcggcgccgtctatgacaccgggcggatcgtgctgtccgcatcgttcaaccagtacgcgccgaagctggccggcgacggcatcgcgcgcgtctacacgctcggcgcgatcgtgccgttcggcgtcaatgcgattcgcgcgtcggttgtctatcgcgatacgtcgggtgtgcgcgacgcggccggccagccggccagggattcggcactcggtgcgatgctgggctacgactacctgctgtcgaaacgcacgggcctctatgcgcgtgcggggttcatccgcaactatggcatctcgacggtgttgctgaacggcaatccgctgccgaccgaaccgggcggaacgacaccgcgcaccgggacgacacccgtgacactgtcgctcggcatgtatcacaacttctgaacgggaattttcgatgcataccctgaatcgcacggccgctgcgccggtcgaatccgggccgcgcgtaacgcgccgcacggtcgttgcggccgcactcggcaacgggctcgaattcttcgacttcaccgtctacagtttcttcgccgcattgatcggcaagctgttctttcccgcgtcgagcgatgcaggcgcgctgatgctgtcgctcgcgacgttcggtgtcgggttcgtcgcacggccgctcggcagcgtcgcgatcggcgcctatgcggaccgggccggccgcaagcccgcgctcgtgctgacggtcgcattgatggcgcttggcaccgggatcatcggcttcgcaccgacctatgcgcagatcggcatcgccgcgccgctgctgatcgtcatcgggcgtctgctgcagggcttttcggcgggtggcgaagtgggggccgcgacgaccctgctgatggagtcgggtgacaccggccggcgcggcgagcgggtgagctggcagatggcgagccagggcggtgcgacgctcgtcggcgcgttcgtcgcgctgacgctgtcgcgcgcactgccgcccgacgcgctgcacgcgtgggggtggcgcgtcccgttcgtgctcggtctgctgatcggcccggtcggctttacctgcggcgccatctggacgatacgctgccgcacttagcggccggcgcaccgcgcgagcgtgcgcgcattccgtggcggcaggtcgcggccggcacgctgctcgtgattggcggcacgtcgaccacctatacgatcgtgtttttcctgccgtcgttcctgacgctgaccgtcggcatgccggcatcggtgtcgctgctgtcgggctgcgcggcaggtgcagtgctgctgctcggttcgccgttcgcggggcggctcgcggatcgcgtgcgtcgtcgcaagcggctggtgggcgtgacgtgcgtcgcgtcggccgtgctcgtgctgccggcgttttacgcgatgaagatgtggccgtcggcgggcaccgcggttgcggtcgtgatcgtgctgatcggcttgatgacgctgtcgagtcccgccggcttcgtgatgatcctcgatgcgtttcggcccgaggtgcgggcgatgtcgctggggatgatctatgcgctcggcgtgacgattttcggcggattcgcgcaactgatcgtcggcgcgatgtggcgcgcgaccggcagctttacgcgcctgcgtggtatgtgctgggatgcagcgtcgcgagtctggccggtctggcgctgttcgcggaagcgtccgacgtggaaggcaggcggtgaacgggaggggcggacacgtgacgtgcccgccctggggatggtgtgcgcgacgaacggacgggcggggccgctccgttcatcgcgcgtgcgctgtcgcgcaatcaggccgcgtcgctcagcgccgggtaatcggtataacccgtttcgccttccgcgtagaacgtctccggcaccggctggttgagcggtgcgccgagttcgaggcggcgcggcaggtccgggttcgcgatgaacagcttgccccatgcgattgcgtcggcgttgccgctggcgagcgcggcttgcgcggtgtcgagcgtgaactgctcgttggcgatcagcgggccgccgaacgcttccttcaggcgcgggctcaggtggtcgcccgaatacgattcgcgcgtgaagatgaacgcgatcttgcggcggccgagttcgcgcgcgacatagccgaacgttgccgccggatcggaatcgcccatcgtgtgcgcgtcaccgcgcggtgcgaggtgcacgccgacgcggccggcgccccacacgtcgatcgcggcgtcgaccacttcgagcagcaagcgtgcgcggttctcgatcgggccgccgtacgcatcggtgcggtggttggtgctgtcctgcaggaactggtcgagcaggtagccgttcgcgccgtggatctcgacaccgtcgaagccggcggccttcgcattctcggcacccttgcggtacgcggcgacgatgcccgggatctcgtcgagttcgagtgcgcgcggcgtcacgtacggacgctgcggacgcacgaggctcacgtggccacccgcggcgattgggctcggtgcgaccggcaggtcgccgttcaggaacaccgggtcggagatccggccgacgtgccagagctgcagcacgatgcgcccgccggccgcgtgcacggcctgcgtcacctgcttccagccttcgacctgttcgtcggaccagatgccgggcgtgtcggcataaccgacgccctgcggcgtgaccgacgtcgcttcggtaatgatcaggccggccgatgcgcgctcgcggtaatagcgcgccatcagcgcgttcggcacgcgcgtcgtacccgcacgggcgcgggtgagcggcgccatcacgatgcggttcggcagggtcaggtcgccgagggtaacggggtcgaacagtgtaggcatggcaaataacctcttcacgaaaggcgggaagccggcgcgtcatgtgcggcggcggcccgcatggccggttcggccgttggctagagttcgcggcgcaatgcgtcgtgaaatgcgtcgatgacggcctcgttgcgctggaaaaacgcccactggccgatccgcgtcgacgtcacgagccccgcgcgctgcagcgtcgcgaggtgtgcggagacagtcgattgcgacagcccgcagcgcgcgtcgatctggcccgcgcagacgccgtgttcatacggcagcgtctggttcgggaaatgcacgtccggcgttttcagccaggcgaggatttcccggcgcacggggttcgagagcgctttcaggatcgcttcgatgtcgagttcggtcggcatggacaggtttggcgtttcgctcgggtaacgaggtatcgtcgatgggcgaatcttatatcggaacttgacgatatgtttgaaagcattgccggcaatagggttgatagcgaagggcgattgcggggacagagcaaggcgaccgcgaaggacgcggagcggagccgccgtcccgccacgcgccatccggccctcagtcagacacgtcgacgatctcgtaccttcccggtgtcgcatcgacgtgcgcgagcgtatcgagcacgcgtatcgcgggcggggagtcgcgagcttctgcaactcgagcagcgcctcgtcgctggatctgcccgggcgacgcaccacattgcgcatcctgtgggatgctacgcggcgaggcgcgacccggacgggttcgacgcggccgatcgcgagccatccggccaagcgcgccgatcgatcgacgcgcgcgtgcgcatcgcaacgtcatgccggttcgtccatcgcgcacgagccgattttttgcggagtctttcatgtctgttcgggccgtcatcttcgatttcgatctgacgctggcggattcgtccgccgcgatcgtcgcgtgcacggagtacgcgttgcatcagttggatgccgccggcgcgacgccggcgcagatcgcggccgtgatcgggctgccgctgcacgagatgttccgctcgctgacgggcgaaaccgagccggcgcgggccgacgcgttcgcgcgtcacttcgtggtgcgggccgacgagatcatggtgcgcggcacgcgcatctatcccgaggtgccgccctgctcgcgcgtctgcgcgagcagggtctcgcggtcgcgatcgtttcgtcgaagtttcgctaccggatcgaggcgatccttgcgctgaaccagttgcaatcgctcgtcgacgtgctgatcggcggggaagacgtgcagcgtcacaagcccgatcccgaagggctcgtgctggcgttggcgcggcttggcttgccggctcgttcggcgatctacgtgggcgaccacgcggtggacgcgcaggcggccgagcgcgccggcgtggcgttcgtcggcgcggtgagcgggatgacgtcgttcgacggatgggcacgtgcgggcaggcaggcggtcgccaaccatatcggcgaactggacgcgatcgtgcagcggatgcggcgcgactcgtccgcggcatcgggctgacgtggccccgggcggtgcccgtgccgatgcgccgcgggtagcgttgcgcctattgccgaggcgggaatcgcggtgtcgagcacacgttcaccgccgagggtggtcgcaactgctgcgccggagagcggggcgtcgacgattcgctctgctacgatcctcaacaccatgcgcccggtgcggatatcggcacgctgcccgattcgcagcgcgtgccggtgttcgactacccggccaccggcgacggattttgcgaccctcgccgttaaagtcatatccgccactcgatccgtcgccatgtcactcatttccgtcgccttcgccaacctccggttctcgcgcgtgctgccggccgcccgaacgctgtcatgcgccgtttcgctcgcggcagcctgtgccgccatcggcatgccgggcggcgcgcgtcccgccgaagccgccacgctcacgcagcgcgaacgcctcgaggcgccggtcaaggccgtcgccggccagcgcgtggccgtcgatacgccgcagggcaatgcggtgctgcccgtctacgccgatcgtccgctcgaccagcccgcgcccgatgtcacgcgggtcttcgtcgtgattcacggcacgcttcgcaatgccgacgcgtactacgcatcggggcgcgaggtcgtcgaaaaggccggtgcggccggcaagggcacgatggtcgtcgcaccgcagttcctgacgcgcgccgatacgcgggcgttttcgttgcccgcgcaaacgctcgcctggacgcaggaaggatggaagggcggcgacgcggcccgtcagccggggccgatcagttcgttcaccgcgctcgacgcattgctcgcgcatttcgccgaccgcagcctgtatcccgcgttgtcgagcgtggtcgtggtcggccattccgccggcgcgcagttgctgcagcgctatgcggtggccgggcacgaaggcgacgcgctggtacgggccggcatcgccgtgcgttatgtggtcgcgaacccgtcgagctacctgtatttcgacgacgaacggccggacggccaggcgatcgcaggcggaacctgccagcgcgcgaacgagtggaaatacggactggagtcggcgccgccctatgtcgcgtcgcaggacgtgcgcgcactcgaaacgcgctacgtggcgcgtcatgtcgtgtacctgctcgggcaggccgacacgaacccttacacgcacttcatcgaccgttcgtgtgcggcgatggcgcaaggcccgtaccggctcgcgcgcgggctcgcgtatttcgattacctgaagaagcggcatccggacgatctcgcgcagcaggtcgtcgaggtgccgggcgtcgggcacgacaatctcggcatgttcacgtccgcctgcgggctcgccgtgctgttcgggcaggcgctgccgcaatcgtgtccggtcgtcgccggtaccgcgccggccgtgcgcgcggaattgccgtaagccgtcgtgccgtcgtgcgataaccgccgcgtcgacgatcgatcggaggccgagcacgcgtgatttcgccatgctgccggcgcgcgatggcggcgccgcgcgtcaggccggtgctccggtgcccggcgccgcgtccgggtcgaataccgtcagcccttccgtcgggtccgtcggcagctcccacggacgtgcggtgatcgcccgccgcgcggcgtcgtaaccggcctgccggcgggccgcgatgccggccggcgtgaaatcgatgtccttcagctgattgtcgctggcgaggcgcggcgccgcgagcttgaccaggtgcatcgtggtttcgcatccccacgcggcgagccggcgcacggccggcgacgcgcgttcggcttccggcacgtggcgggccagctcgcggatcacgtggcgcagccggtggatctgctgctggcgcgcgatgtggctgtcggtgcggctcgcgtactggatgtccttctgtcgctccgacacctgccagatgctctcgggctcggggcccgccggattccacatctgtaccgagaagatgatcgagctgcggcgcggattgtcgtcgagcacgacctcgaccggcgtattcgaatacacgccgccgtcccagtaaggctcgccgtcgatccgtatcgccggaaacgcgggcggcagcgcgcccgagctcatgatgtgctcgatcccgagccgcgtatcgcgcgaatcgaaatagcgcatcgtgccggtgcacgcattgaccgcgctgacggtcaggcgcgggtggcccgcgttcagcaggtcggggtcgatcagcgacgcgagtgtgtcgcgcagcggtgcgatccggtaatacgacgcacgatcgacgccgaggcgcaccatcggcccgagccacgatgccggattgggctggaagaatcccgcgatgccgccgccgatgatcatcagctcggccagcatccggtcccagccgggcaccagcggcgggacgtcgaaacgggttcgttcggtcacgcgccgccagaacgccgacagcctgtcgtaacgctgctccggcggattcccggcgatcagcgccgcgttgatcgcaccgatcgacgtgccgaccacccagtcgggccggatcccggcttcgtccatcgcctgaaagacgccgagctggaacgcgcccagtgcgccgccgccctggagcacgagcacgacttgtccggggaggttcatgcgtgccggttcgctcgcggtcatggctcgcctcgctgcgtgtgaaggtgggtcggaaccgaatggctcgattcagtgtaggcgatggccggcggggatcgcgcgccgcgcatcggcgattcgcgcctgcttcgccggtcgcttccggcgccttcggcgcggtggtcggcatcgcgaagccgggcgtccggcgcgcgcgccgtgcttcgcggtgcatccgcgagcgactcgcgtcacgcgtccgggtaaggcgtgccgtccttgtgcaggaaccggccgtcgcggctcgggctcatcatgtcgatgtccgggcaggtgatcacgtcgtccggcgaacgcgagccgacttcgagatagacggcaaccgcgtccgaccggttgaccaggtgatgaccgttgcccgagttcttcggaaacgccgcgcagtcgcccgcgcgcagcacggtttcgccgccgtcctcgatcatcacgagttcgccttcgagcacgtagacgaattcgtcttcgtcggaatgccagtggcgctgcgccgaccagccgcccggcggcacgcgcatcaggttgacgccgaaatcgcgcaacccgccggcgtcgccgacgcgctggcggatgcgctgcgcgcacggcgcgtcgaacggccgcggatagccgctgccgcggcgttcgggcacggcgttgaggtcgatcctgggcatgggcggctccgtcggccacgcgggcgaatgggatgcgggcattgtaggcgccgcggcccgccgttcgtccgcgcgtgtcgtggtgcgccgcgtcattccaccgtgatggtctccttcatgtacgggtgaatcccgcagaacactttgtagacgcccggcttgtcgaagcggaacgagtacgtgtcgccctggtcgagcgccgacgagtgaaagatgccggcgtcgttgacgacggtatgcggctccccgtcgaggttcttccacgtgaccgtcgtgccggccttgatcgtggtcgacatcggcgaaaacatgaaattgcggatcgtcacgagcgggccgcccgggccctgcgcgaacgcggcgagcggggcggtggcgcacaggatcagcgccgcgacgaggctggcgtgcttgaagcgggtcatgtcggtctccttgcggttcggtgcgtcaggccagcgtcgcatcgtgcagcgacgacgcaaccggatggcccgcgaattcgacggtcgtcacgccgagcatcgacggcagccggtcgcgcggcacggtgagcggcacggggcccgggccgttgccggccgtcggctgcgggaacgcggtggagcgcgcggtgtggaacgtcacgttgccctcgaccttcgacacgatctggtggatgtgtccgttcagcacggtgaccgagccgaagcggcgcagcagcgccatcgtctgcggcgcgtcgccggtgccccagccccacggctcgtagatggtccacatcggcatgtgcgagaacacgacgatcggcgtgctcgacgagcggcccttgagatcctgcgcgagccaagcgagctggtcgtcgccgaagctgccgagcccgttcggcttgaagtgcatcacgttgacgaggccgatgaagtgcacgcccgcgtgatcgaagctgtaatagccgcggttgtcggacgccttgccgaaccggctgaaatattcggcgcccgaaccgtcggtgacgtcgtgctcgccgggcaccgtatgcagttccggcacgcgcagcgcggacagcagctgcgacgcgtggtcgaactcctcggccttggacaggtgcgtgatgtcgcccgtgtggatggccagcgcgggcatcgcgggcatgccgttgacgaggtcgatcgtcttcttgagcgtggccgatacatcgggattcgcgtccttgttgaagccgatgtgcgtgtcgctgacctgcacgaacagcggcttgcccgcgttggccgggagcgcgtcgccggtctgcgcgagcgccaggtcgaacggcgtcaggatgccgcccgacagcgtaaacagcgtgccgaggccgccgaaggccatgcattgcagggccttgcggcgcgaggggcgggtggggtcgatgaagacatgggagcctcgcaatcgtgtgacgaaaccggacggccggatcgtcctggaataaaccggcgccttcgcgtgccataccggcgaagcggcggatttattcccgcgcgttgcgcggtcgatcacccgtgttcgcggcttgcgcggcgatgcgctgtcccggaaagatgacctgtcaatgtcctgtaagtgacacgtcacatttgcgtcacggccgatcgatagcctgccactccgagtcacctctccggagccccttcatgccgaatctcgcggcaacggaaaccagcggtgcggtcggcaaccgcacgcgtgccgtcagcctcgcgctgtttttctgatcgttgcctgcggcatcgtctacgtcggcatccatccgggcgccgatctcggccccgtcaaggaaagctcgatcctcccgttcctgctgctgatcgcactcggcttcgagtgcgtcaacggtttccacgacgccgcgaacgcggtcgcgaccgccatccattcgcccccgctctatccgcccctagccgtcgtgcggtcgggcctccggaacctgttcggcgtgcgcgtatcgagcggcccgggcctgcgccgggatgcggtgcgtaacctgatgctcgcgcgggtgctgacgctgcccgcgtcgatcgcgctgtcggccgtgccgtaccgggcgctgcacgggctgttctgattcgcgccgggggcgccttccggctgcgcggcgcgtggccggtcccgtcgattttcaattcaacacaagacgctaccgatggatatcaggttcttcgatccgaatcgcaccgcgaacgcttcggcgtggcgcgtgctccccaaccgctgggatgccatcgcgtttccgctgatcatctgcctgctcgcgatggcgatcgtcggcttccatcagacgatggcgccgatcggcaccctgcagacgcagaagatctcgctcgatccgtcgaacctgcccgaatacgcgctgcgcaccacgctgcggatgctcgcggcgatggtcgcgtcgcttgcgttcacgctcgtctacggcacgctcgcggccaagagccgccgtgccggcatggtgctgatcccgatcctcgacatcctgcagtcggtgccggtgctcggctacatctcgtttaccgtcacgttcttcctcgcactgtttccgggccgcgtgctcggtgccgagctggccgcgatcttcgcgatcttcacgagccaggcctggaacatgacgttcagcttctatcagtcgctgcgcacggtgccgcgcgacctgagcgaagtgtcgcgcggctttcacctgacgccgtggcaacgcttctggaagctcgaggtgccgttctcgatgccgggcctgatctggaacatgatgatgtcgatgtcgggcggctggttcttcgtcgtcgcatccgaggcgatcaccgtcggcaaccagacgatcacgctgccgggcatcggcgcgtatctcgcgcaggcgatctcggacaagaacctcggtgcggtcggctgggtgatcgtcgcgatgtcggtcgtgatcctcgcttatgaccagttcctgttccgcccgctcgtcgcctgggccgacaagttccggatggagaacaccgcgtcgggcgatgcgccgcaatcctggctgctcgacatgatgcgccgcacgcacctgatccatcagcgctcgtgccggccggctggctgctgtcgcaggccgcgcggattccgctgcgcgcgccgtcgcggcagggtacgcgtgcgcgtggcgcatcggcgcgccgctcgtcgcgcatcggcgacatcgtgtggggcgcgttcgtgatcctgctgacggtgtacgtcgtgtggcgcgtcgtcacgttcgtcgcgaccggcgtgacgatgggcgaggtcggccacgtgctcgtgctcgggctcgtcacgctgctgcgcgtactggtgctgatcgcgatcgcgtcgctggtctgggtgccgctcggcgtgctgatcgggctgcgcccgaagctggccgagaagatccagccgctcgcgcagttcctcgccgcgtttccggcgaacctgctgttcccggtgttcgtgatcgtgatcgtccgcttccacctgaatgcggacatctggctgtcgccgctgatcgtgctcggcacgcagtggtacatcctgttcaacgtgatcgccggcgcgatgtcctacccgaacgactacaaggaagcgacgaagaatttccgcatccgcggctggcagtggtggcggcaggcgatcctgcccggcatcttcccgtactacgtgacgggtgcgatcaccgcgtcgggcggtgcgtggaacgcgagcatcgtgtccgagttcgtgcagtggggcgacacgaaggtcgtcgcgcacggcctgggctcgtacatcgcgcagaccaccgccgccggcgattttccgaagatcatcctgggcatcgccgtgatgtccctgttcgtcactttgttcaaccgtctgctgtggcgtccgatgtacgcctatgcggaatcccggctccgtctcgattgagagtaagcgcgatgcaaaattcgaccgttatcaacgcccccgtcaagacgtcccagccgctgcagccgccgcgcctcggcgaagaaatcctgcgcgtggagcacgtgaaccgcggcttcaataagacgcagggcgaactgctcgtgctcgacgatgcgaacctgtcgctgcgcgaaggcgagatcgtcggcctgctcggccgttccggctcgggcaagtcgacgctgctgcgcatcatcgccgggctgatcgagccgaccggcggcgaggtgacctatctcggcaagccgctgcgcggcccggccgaaggcgtcgcgatggtgttccagaccttcgcgctgttcccgtggctcaccgtgctgcagaacgtggaagccgggctggaagcgctcggcgtcggcgcgcgcgagcggcgcgagcgtgcgcttgccgcgatcgacctgatcggtctcgacggtttcgagaacgcgtacccgcgcgagttgtcgggcggcatgcgccagcgcgtgggctttgcgcgcgcgctcgtcgtcgacccgacgatcctgctgatggacgagccgttctccgcgctcgacgtgctgaccgccgagacgctgcgtaccgacctgctcgacctgtggacgcaaggccgcatgccgatcaagtcggtgctgatcgttacgcacaacatcgaggaagcggtgttcatgtgcgaccggatcctcgtgctgtcgtcgaatccgggccgcgtgatcgccgagatcaaggtgccgttcaagcatccgcgcaaccggctcgacacggatttccgcaagctcgtcgacgacatctacgcgaagatgaccgcgcgtcagaccaacgaggcgacgaagaaggggctggagctcggcagatggatgccgcgcgtgtcgaccaacctgatggccggcctgatcgagacgctcgcgatggcgccgtaccatggccgcgcggacatgccggaaatcgcgcgtacgctgcacctcgaggtcgacgaactgttcccgatcgccgaagtgctgcaatacctcggcttcgcggacgtgcgggaaggggacgtgttcctgacgccgccggcgcgtgtgttcgcggagttcggcacgcaggagcgcaagctgatgttcgccgatcacctgctgaagcacgtgccgctggctgcacggatcaggaaggtgctgaacgagcgcccgggccatcgcgcaccgcgcgtgcgcttcgagcaggagctggaggatttcctgtccgatgaagccgccgaggaaacgctcgacgcggtgatcgactggggcgttacggcgaagtcttttcgtacaacgacaagacggaagtgttcagtctcgaggatgtcgagagctgaagtcggtgcccgaatggcgagcgatcgtcattcgggcagatcgcggctgttggcgtgctgctcgattccgccggtattgagcgattcgatcctctccatccgctgccttgccagctcaggcaaccggttcgtcacgccgatcacgagcgcttcggcgagcgcgagcgccggcacgttggtctgcagcatcgcgaacggctgcccctggatccgcagcacgatctccgcaaattctccgatcggcgaatgccattcgtcggtgaccagcagcacgcgcgtgccgagctggtgtgcggcttgcgcgaaccggatactgtcgcgctggtagcggcggaaatcgaaaatgacgagcacgtcgccgggccccatgtccgccagggcgaccgaggcgaggttcacattcggttcgacatactggacgcgtggccgcgcatacgcgagcgtgaacgaaaacagcgaagcgagcggcgcggtgtaacgcccgccgccgcagaaaacgcgaacgtcctgatcggctagcagcgccacggcggcatcgaacgccgccgcatcgagcccttcgatcgtggtggccagcgattgcgacaaccgctggaaaatcgccgcatgactgtcgcgcagccccgaagccgagtgaaacgcatccatccgcgcgagcggcgaattcatcgcggtgtcgatttcgccgtacagcgcctgctggaacgacgaatagttgggaaacccgatcctgacgacaaagcgaaacacggtcgggtcgctcacgtcggcctgcttcgcgaactgcgcgatgggccccagcccgagactgggatagcgatccagcaacgcctgcgcaaccttctgttccgacggcgtgaagctatccatctgggataacagcaacgccctgatgctcgtccccatcgggcactccgactctctcaatccaaatgacaaacggcagacgtgcgtctgccggcgaacccacgcatgttagccgattgacgtgcggcgggccgcccgcaccccggaattagagggacgcatcgcacggtcggccggctcgtcagtgaatgtaatgaaacatacattgataaagaaaacatccggtcgatattcgttcgtagttcagtgataaccctaggttttggtgtaaaaacccgagtgctatgatcgcggcctcgctggaatgtacggttcattacatcgcgaatcgatgcttcgatgcgtgacgatgcggcgtcgcattccggcatggcacggtttatttgtctggaggattccgtcatgaggcggctcgtagtactcaccctgttgtcggcaatgagcgtgtgcgcgttcgccgcgtcggacccggcggtcgaagcgaagaacggcatggtcgtgtcctcgcagcacttcgcgtcgcagatcggcgtcgacatcctgaaggaaggcggcaacgcggtggatgcggcagtggcggtcggctatgcgcaggccgtgaccaattcgtgctgcggcaatatcggcggcggcggtttcatgaccctccacctggccgacggtcgcgaccgcttcatcaatttccgcgagaccgcaccggccgcggcttccgcgaacatgtacctcgacgcgaagggcaacatcatccccgacgacagcctgtacggctatcgcgcggtcggcgtgccgggcacggtcgcgggcctcgatctcgcgcagcgcaagtacggcaagctgacgcgcaggcaggtgatggagccggcgatccggctcgcgcgcgacggcttcgtgctgacgcgcggcgatacggacatcctcgacacgacggtcgcgcgcttcaggaaggacccggaagcggcgcgcatcttcctccgcccggacggcacgccgctgcagccgggcgaccgcctcgtgcagaaggacctcgcccgcacgctcgagcgcatcgcggagcaggggcccgacgcgttctatcacggcgagatcccgaagatcgtcgaggccgcggccaggcgcgcgggcggcgtgatcacggccgccgatttcgcgtcctaccgcgcgcaggacatggcgccgctgacgtgcacgtatcgcggctacgagttcgtgtcggcgccgccgccgagctcgggcggcgtgacgatgtgcgagacgctgaacatcctcgaagggtacgacctgcgcaagctcggctaccactcggccgcggcggttcactacatgaccgaagcgatgcggcacgcatacgaggatcgcaacacgctgctcggcgatccgaacttcgtcgacaacccggtcgcgaagctgacgagcaaggaatacgcggcgcagatccgcaagagcatccatgccgatacggcgacgccgtcggtggacgtgcagccgggtgtcggcgtgcacgagaagccggagacgacccactattcgatcgtcgacaaggacggcaacgcggtgtcgacgacctacacggtaaacggccgcttcggcgccgtggtcatcgcgccgggcacgggcttcttcctgaacgacgagatggacgatttcaccgtgaaggtcggcgcgcagaacctgttcggtctcgtgcagggcacgcgcaactcgatcgcgccgggcaagcgtccgctgtcgtcgatggcgccgaccatcgtgaagaaggacggcaaggtgttcatggtggtcggttcgccgggcgggtcgcgcatcatcacgatcacgctgcagacggtgctgaacgtgatcgactacgggatgacgccgcaggatgccgtcaccgcgccgcggatccatcaccagtggctgcctgacgaggtctattacgagacctacggcctgtcgcccgacacgctcgcgatcctgcgcaacatgggctacaagatggtcgagcagacgccgtggggcgccgccgagctgatcatggtcggcctgccgggcaccgaagccgcgagccgccagagttccgggaacgattcgtccgtgtccggcaacgtgcgtgtcggcttcatctacggctacaacgacccgcgtcgtccggccggatcggcaatcggctactgaccggatcccgtcggcatcgagctgaatcgccgccgacgacgttcgcccttgctcgagcgtcgttgcggcggcagtccgtcggttcgcggacatccgcgagcctgaccggcgccgccggccgtggccgacacaccgggcacggccggctcgccacgcacgcgccctggcacggcacgggacgcgcgcctttcatccttcaacttcttcccgtgcatcgaattccatcatgaacaaacgaatgtccgcggcaggctggatcctgctcgcgatggcggccggcatcctgatcggctacatgatctatacgcaactgccggacaagcagtccgcggcggagatcgccgggtacatctcgctggtgtccgacgtgttcctgcggctgatcaagatggtgatcggcccgctggtgttctcgacgctcgtcgtcggcatcgcgcacatgggcgacgcgtcgtcggtggggcgcgtgttcgtgaaggcgctcggctggttcgtcaccgcgtcgctgatctcgctgctgcttggcctgctgatggcgaacctgctgcggcccggcgagaacctcgggttgccgctgccggatatcggcgcgtccgcgcatctggcgacgtctaagttcacgctgaaggatttcgtcggtcacatggtgccgaagtcgatcgccgaggcgatggcgaacaacgagatcctgcagatcgtcgtgttctcgatgttcttcggcgtggcgcttgcgtcgctcggcgagcgcggcaagatcctcgtcgcggcgatcgaccagctcgcgcacgtgatgctcaggattaccggctatgtgatgaagctcgcgccgctcgcggtgctggcggcgatggcgtcgacggtcgcgatcaacggcctgtcgatcctgctgaagttcgcggtgttcatgggcgatttctacctgagcctgttcctgctgtggggcacgctcgtcatcgccgggctgctgttcctcggccgccgcgtgttcaagctgctggtgctgatcaaggaagcgttcatgctgtcgttcgcgaccgcgagctcggaagccgcgtatccgaagatcctcgatgcgctcgaccgtttcggcgtgcgccgcaagatctcgagcttcgtgatgccgatggggtattcgttcaacctcgacggctcgatgatgtactgcacgttcgcgtcgctgttcatcgcgcaggcgtacggcattcacctgtcgctcggcacgcaggtcacgatgctgctgatcctgatgctgacctcgaaaggcatggccggcgtgccgcgcgcgtcgctcgtcgtgatcgccgcgacgctgcaccagttcaacatcccggaagccgggctgctgctgattctcggcgtcgatacgttcctcgacatgggccgttcggccacgaatgcagtgggcaactcgatcgccagcgcggtggtcgcgaaatgggaaggcgagttgatgcccgaagcggaagccgaagcgaatgcggcgcggctggatgaggaagccgaagcacggatgaacgaggcggcccgcgaggcggatcgcgtcaccacggcctgaagcggtatcccgggtcttcaggccgcctcggcggggcgggccgcgtcgaggcacgcggccagcaccatcgcggcggcgttgcccggcgtcgagccgagcaattgcggcgcatagacgctgtcgccgatctcgatcggctgccccgacagcgcgcacacgccgcgcttgcgcgtggtgaacagccgccacttctgataaccgtagtgcccggtgcatgcgtcgcgccatgaaatcatcacggtgtctgcggtgggccgctcgagtacgctgatggccggcttgctcgtcgcgtcccacgacggcagccggtcgcgcgtgacgctgcgccgccgcggcgtgccccacgagacggacggcatgtcgaagctgccgatcgcagcgacggtcatgagccagggggcgatacggttgttcatgtcagttttcctcgaaacgttacgcggcaccgcaacgcgcggcatcacgacaggcggatgcgcggccgcgcgcagccgttgatccgttcggcgatccacagcaggctcgccttggagaagccgtgcagcgcctgctggtgccgccggtagagcatcaggtggctgaattgcgcgaatcgccctggatgaagccgccacgaaagaacccgaactgcccgagcgtgccgaacgcgtcgtagtcgctgatcgacacgagcgcgccgaaatcgtggaatgcgaacggcggcatcggcttgccgtcgagccacgcgggcaggtgcttcgcgagatgctcggcctgctgcgtcgcgacctgcgcggtgggcggcagcggccgttcctggccgtcgggcaacaggctcgcgcaatcgccgatcgcgaacacgtgttcgtcgcccgttgcctgcagcgtcgggccgacgacgatctggttcgcgcgattcgtgtcgaggccgccgagcgcctgcatgaaatcgggcgccttcacgccggccgcccacaccatgaggtcggcttccgcaaacgaaccgtcgccgtagtgaaagccgttcgcgtcggccgacgtgacgcgggtcgacgtcagcacgtgaaagccgatctgttcgagccgttgctgtgccgatgcggaaatcttcggcggaaatgcggcgaggatgcgcggaccgctttcaagcagcgtgagttgcagccggtcgcgtaccgtttcgtcgccataggcttgtgccacttccagcaggcggctcagctccgcggcaagctcgacgccggtcgcgccggcaccgacgatcgcgacgcggaacggctcgtcgcgcgcgatgctgcgaaatacgcgcatccgcaacgcttcgttgaaggtctcggcctgcggctggctgtcgatgaaatagcagtgctcgcgtacgcccggcgtgccgaaatcgttggcctggctgccgagcgcgaggatcagcacgtcgtattcgagttcgcgggcgtcgagcacgagttcgccgtcctgagagcggatctcgccgagctgcacgcggcgccgcgcgcgatcgagccccttcagttcgccgggctggtacgtgtaaccgtgatcgcgggcatgggcgaggaagatcacctgctgctgctgcacgtcgcgcgtaccggccgcgattgtgtgcagcatcggtttccagatgtgggtggggctgcggtcgacgacggtgaccagtgcgcgcccggaccggccgagacgctcgcccagacgggtggcgagctgcagtccggcgatcccgccgccgacgatgacgatacgtgtaggggttgccatggataaatcatcacgtgatgaataaggtatgatcctagcgcttcccggcttcgcgtgtcaacggagcggggcaaatcacgcggtttcggcggtgttgaagcggggccggaacaggcgcattcgaatcattcaaggagagcagggaaacgtggctgaagtcactgagcgcgcgccgggcaagcggcgtatgcgagggcggccgctggccggggcgtccgtcggaccggacgtgatattgcgggccgcgcgccgtacgttcgcgaagcgggctacgacgcgacgagcgtgcgcgaggtcgcgcgcgagctgggcatcgacgcggcgctgatcgcccatcatttcggtacgaaggaaacgttgtggctggccgtcgtcgagcagatcgtcgagatcgccgagccgatgttcgatgcgctgcgtgcgttgcgcacgtcgccgctgtcgcatcgcgaacgcgtgcggcgcgcactcgagctgtgcgtcgaccatgagttcgacgaacccgacatgggcatgttcttctcgacggcggcgaccgaagtgggcgggcggctcgaccggctgcaggagcggctcgtccgtccgtattacgacgtgatgttcccgctgctggcggacgccgtgcaggccggcgcgattcgcgcggtcgatccgaacgtgctgttcttcatgatcgcgagcgcgatcggcaacacggtgtcgtacagccacatcatgctggagttcacgtcgctgcccacgcagccggacgcgttccggcgtgccgtgaccgacgccgcgttcaacctcgtcggcgactgagcgccgcgcaccacgcgcacactcacgtcgcggcaaccagccccagttcgcgcaccgcgtttcgcgcggtctcgcgcagcgcatcgacgagcggcgatggcgtccggtacgcgatcgccagctcgtacgcgagcgggctgcccgcacccttcagttcgcagaacgtaatgcctttcggttgcatcggcacgaacaggcgcggcatcagtgcgacgccgatcccgcccgcgacgagcccggccgtcgtctgcatctgtcgcggctgctggacgacgcgcggcgcgaagccggcctgcgcgcacgcggtcacgatcagcgcatgcatgccgggaccgtggtgcgcggcgaacatgacccacgggtcgtccgccaggtcggcgagcgcgatgtgccggcggcgtgcgagccggtgaccgtcgggcagcgccgcgaccatccggtcgcgcagcagcggttcgacgcgcacgtcgcccgcgtcggccaccggcagcacgacgaggccgatgtcggtgcggtcgtggcgcagcgcgagcacctgctcggcggtcgtgccttcctcgagctggaaatcgacgcctggatggcgttcctggaacgcccgcaggatcagcggcaatagcgcgttgacggtgctgtcgacgaagcgcagccgcagcgtgccgccgaggcccgcgcccgcgcggcgggccacggccaccgcgcgttcggcctgttcgagcgcgcgccgcgcttcgagcaggaaggcctcgccggccggcgtgagcgtcgagccgcggttgtcgcgctcgagcagcgagacgcccagctcgtcctcgagcttgcggatcgccgcgctgagcggcggctgcgccatgtgcagccgctcggccgcacgccggaagctgagcgtctcggcaaccgcgatgaattgcctgaactggcgcagatcgatcatgcgatacctctcgtgtatcaatggatcatcgaattcgtattttacctatcacctcaccacgcccagacttgcactgtcggcaatcgtcaacattcgggagggcaggacatgacgggcagtgaacggcaacggacggcgatcgtcacgggcgggtcgagcgggatcggcttcgcgatcgcacggcggctggtggaggatgggtatcgcgtcgcgatcgtcgggcgcgacacggcgcggctggacgcggccgtcgcgcgtctcggcgccgcggcgatcgggcaggccggtgatttgagcgtgcggcgcgaggctgaggcggcggtcgccgcgatcgtcgcgcagtggccttgcgtggacgtgctggtcaacaacgcggggctgaccggccgcgttagcgcggacacggaggcgggcgaggccgagaccgtgtgggatgccgtgctcgacgcgaacctgaaaagcctgttcgtgacgaccctggccgtgctgccgcacctggccgggcgcgacgcgcggatcgtcaacctcggctcgatcgcggcgcgcgccggcagcctgctgccgggcggcctggcgtacgcggcggcgaaggccggcgtcgaagggttcaccgttgcgttggcgcgcgaactcgggccgcgcggcacgacggtcaatacggtcgcgccaggctatatcgccgacacacgcttcttcggcgacggcggcgtcgcgccggccatcgcggcgacgattcgcgagcagacgccggccggccgcgccgggcatccggacgacatcgcggacgcggtcgcgtggctcgccggaccgcgcgcgtcgttcgtcaccggcgcgacgatcgcggtgaacggcggctggcgcgtcgggtgacgccattcgtaccggcggccgggcacggcatcgcgcgcctcgcccggccgccggtcattcgagatccttgggcggcgtatcgccgagccagcgccgcgcgccgggcccgttgcggcccgcgcggtcttccgggttcgtcagcttgcagcgtttcagcgacaggcagccgcagccgatgcattcgtcgaggttgatgtagagccgctgcagttcctcgatccggctcgcgacgcgttgcttccagccgcgcgacagccgctgccaatccttgttgctcggtgcggtgtcctcgggcaggctgacgagctgctcggcgatctcgtcgagcgaatagccgatcttctgcgcgaacacgatgaacgcgatcagccgcagcaccgcgcgtgaatagtggcgatggctcgagccgttgcggtgcgacttgatgagcccgcgcgtctcgtagaaccgcaatgtcgacgccggcacgccgctgcgcgcggccacttcgcggatcgacatcagcggccattgcgggatttcctggatacccatgacacccctccgggaaagcttgacttgaagttaacttcaacttttatgctacgcggcagtttaacccgtcgcgaggcatcatgctctccttatccctacgcaggacgtcgcctttgggcgcggcctgtgcactgctgctggcgttgtcgggctgtcacgacggcaaaggcgcatcgtcggccccggcccttcccgaagtcggcgttgccaccatcgcgccgcgcacgatccgcctcgcggacgaattcaacggacgcgtcgaagcggtcgacgcagtcgaactgcggccgcgcgtgagcggctatctgcagcgcgtcgcctacaaggagggcgacctggtcgcgcagggcgcgctgctgttcgagatcgacccgcgcccgtaccggatcgcactcgatcgcgcgaacgcgcagctgcggcgggcccgcgcggccgcgagcctcgcgaacgtgcagctcaagcgcgtgcagacgctgatcgatgcgcatgcgacgtcgcaggaagaactcgacaacgcgcgcgccacggccgagcaggcgcgggcggacctgcaggcggccgatgcggccgtcgccgacgcgaagctcaatctcggtttcaccgaagtgcgcgcgccgatcgcgggccgcgtcggccgcgcggtcgcgaccgtcggcaacctggcgcgcgcggacgacacgctgctgacgaccgtcgtgtcgcagaaccccgtctacgtgtatttcgactgcgacgaacagagctacctgcgctacaacgcacggcgtgccgacccgaagcatcgcgcgatcggtgccgatccggttcgcgtgggcctcgcgaacgagacgggcttcccgcatgcgggcaccgtcgatttcctcgacaaccgtctcgacccgcagacgggcacgatccgcgcgcgcgtgcggctgccgaatgcggaccatgcgtttacgcccggactgtatgcgcgcgtgcagctcgtcagcggccgcgaccaggatgcgctgctcgtcgacgacaaggccgtgctcaccgaccaggaccgcaagtacgtgtatgtgatcggccccggcgacaaggcgctgcgccgtgacgtgacgatcggccgcgggctggacggcgagcggatcatcgagaaggggatccaggcgggcgaccgcgtggtcgtcgacggcatgcagcggatctactatccgggcgcgcaggtgaagccgaaggcactgcccgtacgcgccgatgccggtgccggtgccggttatggcgcgggcagcggatcgggcaacggtacgcaggccgtcgccgatgccggcgcgccggccgtgcagtgacgggagcgatacgatggatttctcccgattcttcatcgaccggccgatcttcgcggtcgtgctgtcgatcgtcatcttcgcgatcggcctgatctcgattccgatgctgcccgcgggtgaatacccggaagtcgtgccgccgagcgtcgtcgtgcgtgcgacgtacccgggcgcgaacccgaaggaaatcgccgaatcggtcgccgaaccgctggaagaggcgatcaacggtgtcgaaggcatcatgtacatgaagtcggtcgccgggtcggacggcagcctgcaggtcgtcgtcacgttcctgcagggcgtcgatcccgacacggccgccgtgcgcgtgcagaaccgcgtgagccaggcgctgtcgcgcctgcccgacgaggtgcgccagtacggcgtgaccacgcagaagcagtcgccgacgccgctgatgtacgtgagcctctattcgccggacaacagccgcgattcgctgtacctgcgcaattacctgacgctgcacgtgaaggacgagctgtcgcggctgaccggtgtcggcgacgtcggcttgtccggctccggcgactacgcgatgcggctgtggctcgacccgaaccggctcgcgtcgcgcgggctgaccgcgagcgacgtgattgccgccgtgcgcgagcagaacgtgcaggtgtcggccggccagctcggcgcggagccgacgccgaagaaaaacgacttcctcctgtcgatcaacgtgcgcggccggctgcgcacggcgcaggagttcggcgacatcgtgctgcgcagcggcgacgacggccaggtcgtgaagctgtccgacgtcgcgcgcgtcgagctcggcgcgggcgactacacgctgcgctcgtacttcaacgacaaacaatcggccgtggtcggcatcttcctgtcgccgggggcgaacgcgctcgaagtcgcgaaggccgtgtatgcgaagttcgacgaactgtcgaagcgcttcccgcccggcgtcgcgtaccgtcccgtgtgggatccgacggtattcgtgcgcgattcgatccgcgcggtgcagcacacgctgatcgaggccgtcgtgctggtcgtgctggtcgtgatcctgttcctgcagacatggcgcgcgtcgatcattccgctcgtcgcggtgcccgtctcggtggtcggcacgttcgcttggctctatctgctcggttattcgatcaacacgctgacgctgttcgggcttgtgctcgcgatcgggatcgtggtcgacgatgcgatcgtggtcgtcgagaacgtcgagcgcaacatcgcgcagggcttgagcccgcgcgacgccgcgcaccaggcgatgcgcgaggtgtcggggccgatcgtcgcgatcgcgctcgtgctgtgcgcggtgttcgtgccgatggcgttcatgtcgggcgtcacggggcagttctaccggcagttcgcggtgacgatcgcgatctcgacggtgatctccgcgatcaactcgctgacgctgtcgcccgcgctcgccgcgaagctgctgcgtccgcacggcgcgccgaaggatgcgctcacgcgcgggctcgaccgcgcgttcggctggctgttccgtccgttcaaccgcttcttcgaccgcagctccgatcgctatcacggcgtcgtctcgcgcacgctgaagcggcgcggggtggtgttcgcggtctatgcggcgttgctcggggcgaccgcgctgctgctcaacgcggtgccgggcggcttcatcccggtgcaggacaagctgtacctgttcgcgggcgcgaagctgccggaaggcgcgtcgctggcgcgcaccagcgaggtgaccgagcagatgacgaagatcgcgctcggcaccgacggtgtcgagatggtgccggcgtttgccgggctgaacgcgctgcagggcgtgaatacgccgaacatcacgaactcgtacgtgatcctgaagccgttcgaccagcgccaccgcagcgccgcgcagatcaacgcggacctgaacgcacgcttcgcgaccatcggcggcggcatcacctatgcgctgatgccgccgccgatccagggcctcggcaacggctcggggtattcgctgtacctggaggatcgcggcgggctcggctacggcgcattgcagaacgcgctcaccgcgttccaggccgcggtcgcgaagacgccggggatgagctacccggtcagctcgtaccaggccaacatcccgcagctcgaggtgaaggtcgaccggctgaaggcgaaggcgcagggcgtcgcgctgaccgacctgttcagcacgctgcaggtctatctcggctcgatgtacgtgaacgacttcaacctgttcggccgcgtgtaccgcgtgatggcgcaggcggatgccggccaccggcagacggccgccgacatcgcgaacctgcgcacgcgcaacgcgaagggcgagatggtgccgatcggctcgatggtgacggtggcgcccgcgtacgggcccgacccggtcgtccgctacaacggctatccggccgccaacctgatcggcgacgccgatccgaaggtgatgtcgtcgtcgcaggcgatcgagaagctgcaacagatcgcgaaggacgtgctgccgccggggatcgtgctcgagtggaccgacctcagctaccagcaggtcacgcagagcaacgcggcgatcgtcgtgttcccgctcgcggtgatgctcgtgttcctcgtgctcgcgtcgctgtacgagagctggacgctgccgctcgcggtgatcctgatcgtgcccgtgtgcatctgtgcggcgttgttcggtgtgtggctgtcgggaggcgacaacaacgtgttcgtgcaggtcgggctcgtcgtgctgatggggctggcgtgcaagaacgcgatcctgatcgtcgagttcgcgcgcgagctggaaatccagggcaagggcgtgatcgaatccgcgctggaagcgtgcaagctgcggctgcgtccgatcgtgatgacgtcggtcgcgttcatcgcgggttcggtgccgcttctgatcggcagcggcgcgggcagcgaagtgcgggccgccaccggcatcaccgtgttcgccgggatgctcggcgtcacgctgttcgggctgttcctgacgcccgtgttttatgtggcgatccgcaagctcgcgggcggcacgccggccgtgtggagcgaacaccacggcaccctcgaaggagaaaccgatgagcgccgctttccgtttttccgcgctcgcgatgtcggtgacgctcgccgcatgcgcggtcggccccgatttcaggcggcccgatacggccaccgccgagcggtttgcccgcgacgcgcatccggcggcgcagcgcgacgcgttgccatccggcaagacgccggatacgccgcccgacgcgtcggccgatgccgatgccgcattctggcgcggtttcggcgatccgcagctgacgcagctgatcgacacggcgctcgcggcgaaccaggatctccaggtcgccgtgtcgcgctacgacgcatcgaatgcgctgctgtcacaggccacgttcgaccgctacccgacgatcaccgcgagcgggaagatcggccatcagctgatgagcaaggaccaggcgttcggggcgccgcgcagccagcgcgatacgccgacgtccagcgtcgggatcaatgcggcgtgggaactcgacctgttcggccgcgtgcgtcgttcgatcgagtcgcagcgcgcggagacggccgccagcgcggcggacgtgcgcgcggtgcgcgtcgcgatcgccggcgaggtggcgagcacgtacgtcgacttgcgcggctcgcaggagcggctgcggatcgcacgcgagaacgccgacaaccagaagcagacgctcgcgctgatcaatgcgcgcgtcggcgcggggcgtggttccgaactcgatgcggcgcgggcgcgcgcgcagtacgaatcgacgacgtcgcggatcgccgtgtatgaagcggcgatcggcgtcgacgagcaccggctcgcggtgctgaccgggcagacgccggatgcgctgatcggccgcttcgatctcccgaaggccgccgggtcggcgggcacgcccgtgccgctgccggtgctggtcgccgacatcgatcccggcacgccgggcgacctgctgcggcgccggcccgacgtcgcggccgccgaggcgcggctgcatgcggcgaccgcacgcgtcggcgtcgcgacggccgacctgtttccgcgcttcacgctgtcgggcctgctcggcagcgcgacgagcagctacgggttcttccgtgcgggcagcgatacgaacctgatcgcgctcggcatcgactggtcgttcctcgacgtcggccgcgtgcgcgcgcggatcgccgcgagcgatgcggaagcggccgggcagctcgcgcaataccggcagaccgtgctcggggcgctggaggaaacggagaacgcgctgctgcgtgcggcccgcacgcgtgacgagacggaccatctcgtgcgggccgcgaccgacagcgcgcgtgccgcgcaactggcgcaggcgcgtttttcggcgggcgcgatcgactactacgaagtgctcgacgcgcaacgcacgctgctgcaggcgcaggatgcggcggccgacgggcggatgcgcagtgcggcgtcgacggtcgcgctgtacaaggcgcttgcgggcggctggccgtcgggaacggggcaggggccgcaaggcccgctcgcgcaggcggggcagtagcgcgggcaaggcggcgcggcaggccggcgcaatcgtgcctgccgcgcgccgcgtgactacacgctggccggatcgatcttgtcgatgtcgatgccgtagcgtcggatggcttcgccgacgcgtgcacgcgggatcgcgccgtcgtcggcgagcgccttcagcgccgcgaccacgatgaagtgccggtcgacctcgaagaacgtgcgcagcgcgtcgcgcgtatccgagcggccgaagccgtcggtgccgagcgacacgaagcgccggccgtcgacgaacgcacggatctggtcgccgacgatcttcatgtaatcggtcgcgacgaccaccggccccgtgcggccgtcgaggcattgctgcacgtacggcacgcgcggcgcctcatcgggatgcagcaggttccagcgttcggcggccagcccgtcgcggcgcagctcgttcaggctcgtcgcgctccacacgtcgctcgacacgccgaagtcctgcgcgagcaggtcgctcgcggcgatcacttcacgcaggatcgcgccgctgcccatcaactgcacgtgcggcacgtcggccgcgcgcgacgcgccttcgcgcagcaggtagaggcccttgagaatgccgtcctccgcgccgtcgggcagcgccggatgcgggtagttctcgttgagcagcgtgatgtagtagtagacgtcctcctgttccgcgaacatccgccgcaggccgtcgcgcacgatcaccgcgagttcgtacgcataggtcgggtcgtacgacacgcagttcggaatcaccgacgacagcacgtggctgtgcccgtcgtcgtgctgcaacccttcgcccatcagcgtcgtgcggcccgacgtcgcgccgagcaggaagccgcgcgtacgcgcgtcgccggccgcccacgcgagatcgccaacccgctgcagcccgaacatcgaatagaagatgtagaacgggatcgccggcaggccgtggttgctgtaggcggtaccggccgcgatccacgacgcgatcgcgcccgattcgttgatgccttcctgcaggatctgcccgtccttcgcttcccggtagtagctgagctggcccgcgtcctgcggcgtgtagagctggccgagatgcgagtggatgccgatctggcggaacagcccctccatcccgaacgtgcgggattcgtccggcacgatcgggacgaccagcttgccgagcgccgggtccttcagcagcgtgccgaggatgcgcacgaacgccatcgtcgtggacagcgcgcgttcgccgctgtccctgagctgcgcgtcgaacgcggcgagcgggggcaccggcagcggcgtcgcttcgctgaagcgggccggcacgtgaccgccgagcgcggcgcggcgttccgcgaagtagcgcgcctcggcgctgccgggttcgggtttcaggtacggcaggtcgtcgagttgcgcgtcgctgaccggcagcgcgaagcggtcgcggaacgcgcgtacggcatccgcgctcatcttcttcaactggtggttcacgttctggccttcgccggcttcgcccattccgaagcccttgaccgtcttcgcgagcacgacggtcggccgcccgtccgcatgcatcgccagcgtataggccgcatgcaccttttccggatcgtggccgccgcgcgcgagtttccagatgtcgtcgtcggacaggtcggcgacgagttcgagcagttcgggatacttgccgaagaaatgctcgcgcacgtacgcgccgctctgcgacttgaaggtctggtagtcgccgtcgacgcattccatcatgcgctgacgcagcaggcccgttgtgtcgcgttcgagcaagcgatcccagccgccgccccagatcaccttcacgacgttccagcccgccgcgcggaacgtgccttcgagttcctggatgaccttgccgttgccgcgtaccgggccgtcgagacgctgcaggttgcagttgacgacgaagatcaggttgtcgagccgttcgcgcccggcgagcgagatcgcggcgagcgattcgggctggtccatttcgccgtcgccgagaaatgcccagaccttgcggccctgatgcgctttcagcccgcgatattcgaggtagcgcatgaagcgcgcctgatacgcggccgtgagcggcccgagccccatcgacacggtggggaattgccagaaatccggcatcagccgcggatgcggatacgacgacagcccgtcgcgtcccgcttcgcggccggtctcgcggcggaagttgtcgagttgcgcgtccgtgatgcggccttccaggtacgcgcggccatagatgccgggcgccgaatggccctggatgtagaccatgtcgccgtcgaaagtatcagtgcggccgcggaagaagtgatcgaaaccgacgtcgtacagcaccgcggccgactggtaggtcgcgatgtggccgccgacgttcgaatgccggccggcgcgcagcaccatcaccatcgcgttccagcggatcatcgcgttcaggcgccgttcgagcgcgagatcgcccggataggccggctgccgttcgcgcggcaccgtgttcacgtacgcggtcgtcacgcggccgtgcaggtcgccgtggcgcgccgcgtcgaggtcggaaagccggtcgatcaggtaatgcgcgcgcgggcggccttcgagtgcgatcacggattcgagcgcatcgatccattcgcgggtttcctgcgggtcgatgtcaggtagcgcgagaggtgcggtcatgcaatgtctccagaagcataaggctgcgcggggcggcggtcgtggcgccgtatcgcgcgacgggacgcccgtcgatcggcgggcaggtaattgcaattgcaatcgtatgggggcaattgttatcgaggtaaaatttaattgcaactgcaattcaatgagaggaacgacctgacatgagcgcacccgaacccgatctgtggttctcgttcgtccgcgcgcaccggacgatgattcgcgaaatcgagcgccgcctcgcggctgccggcctgccggcgtatgcgtggtacgacgcgttgtggggctcgagagcgggcccgacggcacgcgccggatgcacgagctggccgacgtgctcgcgatcgagcgttacaacctcacgcggctggtcgaccggctcgagcaggaagggctcgtcacgcgcgcccgttcggcggacgacggccgcgccgcgtacgcgagcatcaccgacaaggggcgcacgctgcgcaagaagatgtggaaggtgtaccagtcgacggtcgcggaactcttcctcgatcagttcggcggcaaggagcaggcggcgatggccgccgcgctcgaccgtgcgaccgccgcggcgcgaggcggcggccgacgcgaagtagcggcggcccgccggcgcgtcagccgctcgcgtggcggcgcatcgcctgcacggcccagtcggcaggcacgcggccgtcgtcggccagcaggcgaagcgcgactgcggcgatccagcgcgcattcggcgcgcgtgcgccggcgtccgggcccgccgagtccgcaccgagcgccgcgaagcgggccgggacgaacgcgccgatctgcgcggcgacgtgccgcgcatagccggtcacggcgagcaccggcgtgcggctgtcgccgatgcatcggcgcacatgcgcgacctgcggctcgtcgtgcggatgcagcaggttccaccggtcggccgcgtgaccgtcgcgggcgagctgcgtgtagctcgggcagctccagatcgtcgaatcgacgcgccattcgtcgcgcagcagatcggccgcctcctgcacctgtgccagcgtgctgcccgcgccgcacagccggatccgggcggccgggccggccgccgcccgccggccggcccgcaccatgccgctgaacgcatcgcgggccgcggtggccgacagcggtttcgcatcgggcacggggtcgtcgtggctcgcgaggtagcagaaccccggctggccggcgacataaagcgttcgcagcgcgtggcgcaggatcgcgatcgcctcatgccccgaggccggatcgtatggcgtgcacgcggggttcgcggccagccagtgcgggacgtcgggcgtcacgcctttcggccaggacgacgcgagcgtttcggcatcgttcacgaagatcccgcggtcgacggtttcgatcgacgccagccgcagccggtcggtcgcgcgggcatgcagcaggtacagcagcggccgctcgaaccgcttgcgcgcatcgagaaaccgcagcggccaggcgctgatgcggcgatgcgcccccgcgtctgccaacggcgcacgcgtgtcggctcgcacgatccagacgtgttccgctgtcgccgcatcgcgttcgaggcaatcggcggccgcgcgcatcgcgccgagcggcgacaccgcacggccacgcggcgcgagccgctgcgtcagcagcttttcgaggcaggccaccgcggcgcggcgggtgtcgggcgtccgcacgggcgggccggatcgcgcagtctgcatgtccctccttttggtattggcatgtcgccggggcgtcggttccggcataggattgcaattgcaacgattgtagttgcaacgataaccggaagacaaggaccgacatgacttcgacgcattccctcacgttctatacggccgacacgccgaacgggcacaagatcgcgatctacctggaggaggccgggctcgcgcacgagcgcgtgcacgtgaacctgtccgccggcgagcagcgcagcccggcttatctcgcgatcaacccgaacggcaagatcccggccatcgtcgaccacgacaccgggctgaccgtgttcgagtccggcgcgatcctcggctatctcgccgcgaagacgcgctttctgcatccggaaacgctggccgagcgcacggcggtgcagcaatggctgcacttccagatcggcgggatcgggccgatgctcggccagctctggtggttcctgcatgcatcgaagacggtcaatgcgcaagcgctcgagcgctaccggaacgaagcgcggcgtctctatggcgtcgtgaacggccgattggcggaatcggcgtatctcgcttcgtcgcggtactcgatcgccgacatcgccgcgttcccgtggctgcgcacggcggccgagctcgatctcgacctcgccggctacccgcacgtcgagcgttggctcgccggtatcgaggcgcggcaagccgttcagcggggcctgatcgcatgccgcgcaccggcggcagagcgcgcgaactgacgtcgcatcgcccgcgccgtacggatggcgcgggcgccggccgccggcctgccgggaaacattgttctccttcgtcgtaaacgtctcgaatgcgtgatatttgcgccgtgcaatccggtttagagtggccgcgaatcgatgacgatgtgtcgtatcgccgcggtcccgggccgtacagatgcacgagaggagctggagacaaatgagtgaaggcaggattacgcaggtcgaatcgttcggtttcgagcgcattcccgatgcatcgcgctatgcgcggccgatcgatctgttcaggttgctgttcggcggctgcaatacgttttccacatcggtgctcggcagctttcccgtgctggtcgggctgtcgttcaaggcgggtgtctgcgcgatcgtgctcggcgtgctcgccggcacctgcatcctcgcgccgatgagcctgttcggcccgcgcaacggcacgagcgaccccgtgtcgtccggcgcgcatttcggcatccacggccggatcgtcggctcgttcctcgcgctgctcacgtcgatcgcgttcttctcgctcgcggtgtggagttcgggcgacgcgctcgtcggcggcgcgcacaacatggtcggcgtgccggtcaacggcttcacgctcggtgcggcgtacatggtgttcgcggtgctcgtgctgatcgtctgcatctacggcttccgcttcatgctgtgggtcaacaagatcgccgtgtgggccgcgagcgtgctgttcgtcgcgggcctgttcgcgttcgccggcctgttcgacatgaactacgcgggcacggtgcagcagggcagcgcgggcttctgggccgcgttcgtcggcgcggtgctggttgcgctgagcaacccggtgtcgttcgcgtcgacgctcggcgactgggcccgctacatcccgcagcacacgccgaagcatcgtgtgatgggcgccgtgttctccgcgcagatcgcgaccttcgtgccgttcttcttcggcctcgcgaccgcgacgatcatcgcggcgaaggcgcccgcattcattgcgtcgaacgactacgtcggcggcctgctcgcgatctcgccgcgctggttcctgctgccgatgtgcctgatcgcgatcatcggcgggatgtcgaccggcacgaccgcgctgtacggtaccggcctggacgtgtcgagcatgttcccgcgcctcctgaatcgcgtgcgtgcgacgctgctgatcggcacgatcgcgattgcgttcatcttcgtcggccgcttctggttcaacctcgtcgaaagtgtcgcgacgttctcgacgctgatcgataccttcagttgcccgtggatggcgatcatggtgatcggctacgtgacgcggcgcggccactatctcgccgacgacctgcaggtgttcaaccgcgggctgcgcggcggccattactggttcacgcacggctggaacgtgcgcgcgatgggcgcgtggctgccggccgcgttcgtcgggctgtcgttcgtgaacctgccgggccagttcgtcgggccgctcggcaacctcgcgggcgggctcgacctgagcgtgccggtgtcgctggtgatgggcgggatgttgtatttcgcgctgctgacgctgtacccggaaccggacggcgtgtacggcccgcacgggcgccgcttcgtgcgcggcggcacgcaggcggcgcgcggcaacggcgcgccggcgatccagccgaagggatactgagcggcgcgtggtgcagcgctgcgcagatgacgatgccgccgcgcggagagccggcggcatcgtcgtttcggggcgtgtgatcgcgagaggaagaggccgcaacttccacgtgccgtcgccgcaaacgaaaacgcttgcccggctggcaggcgcgcgccggcttcgatgcgagtcagtggaacgtgctgcccgcgagcatcccgccgtcgacgatgaattccgaccccgtgcaatacgcggattcgtcggacgcgaggaacagcacgaggctggcgacttcccgggcttgccgatgcgcgcgatcggcaggccgctgtagatcgacgacggatcgaaatccgcgaactcgggcgggcgcgccatcacggtatcgatgcctcccgggtgcaccgagttcacgcgaatgccgtagcggccgaattcgagcgcggcggccttcgtcattccgcgtaccgcgaacttgctggacacgtacgcgctgccgcccgcgacgccctccatcccggccgtcgacgacacgttgacgatcgagccgccaccggcttccttcagcgcggccacggccgatttcatgccgagccagcagccgacctggttcacgtcgatcaccttgcgatagtcgtcgagcgaacacgcttcgatcggcacgagcttcaggatggccgcgttgttcacgaggatgtcgagccggccgaaatgcgcgagcgttgcatcgacggcagcctgccagccggcctcgctcgtcacgtcgagatgctggaatcgcgcggcgtcgccgagttcggccgcgacgcgccggccggcgtcgtccagcacgtcggcgatcaccacgcgtgcgccttcggcgacgaaccggcgcgcttccgcttcgccctggccgcgggcagcacccgtgatcagcgccaccttgccttcgagtcgtttcatgctgcttgctcctgttgagtgtagggctcgcgcgggtccgctcatgcggaggcggccgccgcgtcgatgatgcgaaccggatcggtgccgtcccgggtgtgtgattcggcgatgccgcgcgcgatcatgtcgcgcatgccggcgccctcgatgaattcgacgcgcaggccggggtcgtcggggtcgtcgagatacgcgacgcgcgtggccgggttgcccgcttcgaacacgacgcgcaagccgcgtgcggtgaaccgtgcgatcgccgcatcgagatcgtcgacgacccacgcgacgtgatgcagcccgacgagcggttgcccgtgcacatcgcggtacggcgacgacgtgtcgttcgtcacgtgaatcagttcgatctgcagatcgccgcgatacgcgagcccgacgtccatcgtgaccgacaccggctcgccgagatgatggccgtcgaggcgcacgttgcggaatacggtccacgggccgatggcgtggcgttcgcgccagcgcgcgatgctgcggtcgagatcggcgaccacgtagccgatctggtcgatggggccgaggactgggtcgttcatggcgtctccgtggcggacgcccgtgagcgtgccgcgcgatgaatggcggtcatgatcgcaacaaagcgcgcgcggcgtgccatccaaacggatgagtgggcgcgcttcgtcccggcgtgacgggtgggcgcgggtcgtcgcgacgatgccggtgcgtcaagcgccaggtagcggccgctgccagccgttccgcgccaacgccggcggcccatcggtgcgggcggcaggcagggtgccggttcagccgatggtcatcatcgcgggcggcggcctaccgcggccgccgtccggtagttacgcttgggcgatcatccactctgtccggaaggtcgccatgtcccggctcgattacaagttgctcggcccctgtctgctcgcgatcgcgctcgacgcgatgggattcgggctcgtctatccgatgatgtccgcgatcttcagcgatccgcacgcgggcatcctgccggccgacgccggcgcgcacgcgcgcaatttctacctcggtctcggctacgggatctatccgttgtgcatgttcttcggctcgtcgctgatgggcgaactgtccgatcgctacggccgccgcaagatcctgctgctgtgcgtgaccggcctcgcggccggctacgcgatgatggcggccggtgcgtggcatgcgagcgtcgcgctgctgttgatcgggcgcgggctcaccgggctgatggccggctgccagggcatcgcgcaggcggcgatcaccgacctgagcacgccggaaaacaaggcgtacaacatgagcatcatgtcgctcgcgttcagcgcgggcgtgatcgtcggcccggtgctcggcggcgtcacgtccgaccgcacgatttcgccgctgttcgactacggcacgccgttcgtgctcgttgccgggttgtcgctgatcggcgcgttctggacctgggcgtcgtatcgcgactcggccgtgccgcgcggcgacacgcgtatcgatccgctgctgccgctgcgcatcatcggagaggccgcgcgccagcgcaacgtcgcgttcctgtcggtggtgttcttcctgatgcaggtcggctacgggctctacctgcagaccatcatgctgctgttgcaggcgaaattcggctacacgagcgcgcggctcgggctgttcagcggcgtgatcggcctctgcttcgtgttcggcctgctgttcgtcgtgcggctgatgctgcgcgtatggcgcgtggtcgacatcgcgaagacgggcctcctcgtcgcgggcgtcggccaggtcctgtccgcgctgtttccgcacgagccggtgctgtgggcgctcgcgatggtcgtcggctgcttcgacatggtcgcttatacgacgatgtacacggcgttctccgacgcggtcagcgaggaccggcaaggctgggcactcggcgtcgcgggctcggtgatggccgtcgcgtgggtcgtcacggggcgctcacgaacctgctgccggtgttcggcgagatcggcctgctgctgatcggcggcgcgggcttcctgctcagcttcgcgatgatggtcgcgtacggccgcacgcagccgggtgcgcgaacggccgcgctgtcgtaggcggcaggcacgttggcccgatcctgtcggacgttgtcccgcgcgcggctgtcgcgcccggccgcgcggcccgacactggcgcctcgcggccggggaacgtccgggccgcgtccggcggcgccggctggcccggcgcgccgttccttcgatacgccaaccgagagagcgacccatgcaacatccgaccatccgtaccctggcgggcgcgaccgcgccgacatcgatcgccgccgcccgcaccgcgctgctggtgatcgatttccagaacgaatacttcagcggccggctgccgattcccgagggaccgcgcgcgctgggcaatgcgcagcgcgtgatcgcgttcgccgatcgcgtgggcattccggtgtttcacgtccagcacgtcgattcgcccgacagcccgatcttcgcggacggcagcgacggcttccgctttcatgcgagcctgcagccggcgccgcatcatgcggtcgtgaagaaaacctcggtgagcgtgttcccgacgacggacatcgatgcgcgcctgaaggcggccggtatcgacacgctgatcgtcacgggcctgatgacgcatgcctgcgtggccggcgcggcacgcgatgcggtgccgctcggctacgcggtgatcgtcgtcgacgacgcctgcgcgacgcgcgacctcgacatcgcggagggcggcacggtatcgcaccgcgatctccatcgcgcgacgctggctgcgctgtcggacacgttcggcgacgtgctgacgaccgagcaggtgctcgcgctcggcgtcgcctgacggccgccgggttcgtgcttcagtcggcccagcccggcgcggcgtacacgacttcgccgcggaagcacgtctcgatcacgcgggtttgcgcgaacgtctcgacgggatgggcgaacggattgcggtcgaggatcgcgaagctcgcgtccttgcccgcttcgagcgaacccgtgcagtcgtcgaagcgcagcgcatacgcggtattcaccgtataggcctcgagcatcgtgagcaggtcgaggcgttcgtgcggattccacggcgggctgtcgggctggtcgatcagcaggtgcgtgacgcccgtctggatgatctgcatcgggtccatcgtgctgaccgaccagtcggagccggccgcgagcatcgcgccggcgttgcgcaggctgcggaacggatagttgcgcgcggtgcgttcggcgccgagcaggtcgcgatagagctgctgctgctcttcgcgcgcggccgtccacagcgtctgcacgctggcgatcgcgccgagccggttgaagcggctcatgtcggccggatcgacgagctgcaggtgcgcgagctgcgcgcggcggtcgcgcatgccgttgcggatccggacatattcgagcgcgtcgagcgtcatgcgcaccgcgcggtcggcgagcgtgtggaagtgcaggtcgaagccggcggaatcggcgagcaggcagatctcgttcagcgcgtcctggctccacagcgcgaggccgcagtcgtcggtgccggcgtacggctcgagcagcgcggcggttttcgattcgggcacgccgtcgacgaagatcttcaccgtatgcaggcgcaggttgtcgcattcgtacgcgcgacgccaggcggcgaagcgctcgatctgctcgcgcggatcgcggcgcgggttcgcatagaggcccgcgctcatgtacaccttcagcgtgcccgcgcgctgcgcgtcggcatacgccttgagttcggcctcctcgacgcgtgcgtcgaaccagccggtgatgccgtagccgtgcgccatcgcgtgcgctttcgcgagcgacttcgggtagccggccgggctcagttgcggaatgagcgggcagacgcgatagaacgccgcttcgtgcacgacaccgttcggcgcgccggacgcgtcgcgttcgtagacgccgccggccgggtcgggcgtgtcggcgtggatgccggccgcttcgaggcccttcgtgttgaggcagccgctgtgcacgtcgaagccgaccacgagcagcggccggtcgggcacgatccggtcgagcagttcgcgggtcggatacgcgccgaatgcggccaggctggcgccgccgagatagacccatggctcgttcggcgtcgcatcggcgcaggcgcggatgtgctgcaggatcgtatcgggatcgttgatgccggacaggtcgaagtcgccgaggatctggtggccttcgagcgggtgcacgtggccgtcgatgaggcccggcagcatcagcctgccggccaggtcgacggtgcgcgtcgcggggccgatgagcggacggatatcgtcgtcgcggccgaccgcgacgatcttgccgtcccgggtggcgagcgcctgcgcgaagcggcgctgcgcgtcgccggtgtaaagcaggccgttcaggtaggcggtgtcggcgtattgcatgtgtctcctccggatgggggctgatcgacgggcgcacgtgtccggcgggcgggccgagggctcgtccggtcgcgtgaacccggtcgggttgaatgggacggggcgactatgtgccggtgctgcgcggcaagcgccgcgatgcgtcgcggtgaaggccggccgccgccggggcgtcatgccgatcgcgccgccgggcctgaagcggcagatcgatgggcgacgcgcgcgcggccgtgcgggccggcgtccatccggtattcggcattcggtgtctccgtggcatccgacgcgttcccgtcgtcgggtgagtcagatactaggagcagggcggccggctgtctgtcatcgtttttaggacaacctgcgacaaagccggcgggggcggcgggtgtggccgggatgtggagtcgtcgtctagcgcccgcggtctgccggcggttcttcctcggtcacgcaccacgcgaacagcccggcccggttcgccacgccgagtttcgcgagcgcgcgcccgagataggtgcgcacgctgctcggcctgagtgcgagcgtgtcggcgatccggggacgggccggccttgcagcaccgcgcggcacacgagccgttcgcgctgcgacagtgttgcgccgctggccgacaggcgctgttcgaaccgctgcaggagcgcgccgtcgtccgagcgtggcgtcaggcgggcgagccgcgcgtgctggatcagcagcggcagcacgaaatcgccgagctgccgcagcagcgccagttcggccagcgtataggacggctggccgcgccggcggaacagcgagaacgcatagacatagtcgcgctcgctgccgagcagcgtgcagtcttcgccgagttcgccgagcgcgaactggcggccgtattcggttgccgtgtcgacgtcctcgttgcacgagaacacgagctgcgaatcggtggtgcgctcgatatgcgggagcagcgtgtcgttgcgccagtcgccctgtgtatacagatcgagtgcgtggcgcgtgccgtcgggatcgtcgccgcccgcgaagaacagcacgtcgacgctgtcgaccgactgcgacggcgcgtcacgccggtagcgcgtcgcgacgctgtaatgggattgcggatcgacggtttcgcgcagccatgcccaaagccgggcgggaaactgcggactgccgaggctggcgaccaggtcgccggcattgctgaggaaatatgggcggggctcatcgttgacaccgtcttcgcgaacggccgcccgtgccggccgtgtttcgcgtgcgacggcgagccggcggcgcggcggccggcggtgcggtcatgcgggacggaggccggcgcggcggcgaagctcgattgtaggagacttcgccgccgcgaggcattcgcgcttgcccggcgggcggcagatcgtccgtcgacgggcggcgcgcatcgttgcgcgccgcgtggcggccccgcgcgtcagaacatcgtgttcgcgttcgcggacgtttcgggtaccggctggatcacgtcccagtgttcgacgatcttgccgtccttcacgcggaagatgtcgacgacggcttcgccgcggtcgcccgggcgctcggtcgcgtgcacgtgcaggtagacgaggtcgccgtcggttgcgctgcgcacgatgcgcgcgcgcgacgccgggttcttctggaaggcgccgacgaagtacgacacgaatggcttcttgccgtccggtacgtggggttgtgctgtttgtagtcgtccgcgacgacggcggcggcctcgaccgcttcgtgcttgttgaagaagcggtcgtagaacgtcagcacgagctggcggttggcttcctcggcggccaggttgcgcgtggccgggccggcggccagcgcagccgtcgacgcggccagcaggacgagcgcggcaacggtgcgaacggggagcggagcgatgacatgtagcgggttccttgtctgacgaagcgtgggttggcgcgcgatgcgcgacggcgggtcgagccggcgatgacgatcggcggacgacggggcagggtggcggatgcacgggcgttgtcgacgcgagggattcgccgcccggttcgtatcgtcgagatacggagtgggcgcgtcgtcgtcatgcttcgttgaactgccgaatccgtgcggctgccgggccgctcgaatggtacagttgccgcgaacccgtcacaagaagtcagcgcggtgtgaacaggtcacaccgcgctgaccatgtgttgcccttgaaagagaatcccgtcatgccgttcccgcccgccgacgaaaccgtcgaactcgatcagccttgcccgatccgcgatgtgctcgaccgcatcggcgaccagtggagcctgctcgtgctcgaagcgctgtccggcgggacgatgcgtttcaacgaactcgcccgcgcgatcggcgatgtgtcgaagcagatgctgtcacgcacgctcaagcggctcgaacaggacggcttcgtcagccgcacgctgttcgccgaagtgccgccgcgcgtcgaatatgcgctgaccgacctcgggcgttcgttcctgacgccgatgcaggcgatgatccagtgggcggacgaacatcatcgcgcgatctgcgccgcgcggcgccgtgcacgggagctggacggcggcgggcgctgagcagggcgtacgcgctgttttgtcgatggacggtgtgcggcgaatcgagtgcgatgcgacgaggcatgccgcgattgcacgtgcattgccgcatgtgatttcgttatccgaatgatctcgacggggcggcaggcatcgccgaagtttcaatgtgctccgttcgtcccgaatgcgggaatgcactggcggtgccccgcttgcggagtacgcgtcggggcgattgcaatggcggtctttcgctgcatggcgcatgagaggtgcggcaggggctggccgaaccgggatggcgcatcgcagaccggcgggcatatcgatggccgcgggtgcctgatccgatggacgcctgggcgcatgcgtcggggcgaggtggggcagggcgcgcgggggcgcctgccgggcatcatgatgtcgaggctgaatggcgcgggctcgtcgcgccgcctggttccgggctgccatcggccgagtgcggggtgccgcgcgcctgcctatcgccacgtgccgtcgacgtagatccacacctgtccctggcggcgccagtagccgggcacccatcgacgcccggggcgccgtgcgacccagcggcccggcacccatatatagcggcctcgctgccagcgccagtaaccgtctgtccatatatagccgtgcggccgtggcggcggtgggcggcgatcgtgtctcgcagcaggcggcgcgaagcccgggcggtccgcatagggcggcctgccgggcacgcggttcgggccgggcggccgatatccgggcggcgggggcggcacgggctgggcagaagcggcacggagccagccgccggtgccgacgaaggcggcggtcaatccgatggcgcgcaacaaggagcgtcgattcatggcgtgtcctgttcagtattcgaggctgccttacattagcctgccagtccgccgggcgggttacgcgtgcggtcaaggctgttaccgtgtgtcacggcaggcgggcgaaccgccagcgggcggaggccggtctcgctgtttttctgcggctgacgatggatgttgcccgcgctgcacgaacatcgcgtcctgtttaccggctgacggatgtgttttaggcgctcggagccagaaattcgagatcgaatcgggtaaaatttacctattccggggtgcgccgaatccgtttgttgtttctatgcaaccgtcaagacgatgacatgaaagaatggtgcgatggaagcctccaaaagcccccgtcaagaagtcaaaaacaaacgtcaaaacaaatacttataactcggccccactttcattatttctagttctggaaaagcttatttctttatttgcggatcgctccctagggtacacccctaaactcacggttcccaaacgggcaactatccgggcgcggccagcaggatcgatggcgctcccgggcggttgcagaccgtttatgaacaaggtcgcgagacctgcctcttttagaagggagctccacgaatgaacaagactctgatcgttgcagcagctgcagcatcgttcgcaaccgtcgctcacgcgcaaagcagcgtcacgctgtacggcgtgctggacgcaggcatcacctaccaaagcaacgtcggcggcaagtcgctgtggtcgatgggctcgggcgttgaccaaagccgtttcggtctgcgtggttcggaagacctcggtggcggcctgaaggcaatcttcacgttggaaagcggtttcaacatcggtaacggcaagctgggcaacaacggcggcatgttcaaccgccaggctttcgttggcctgtcgagccagtacggcacggttacgctgggtaagcaatacgacgcaacgcaagactacctggcgccgctgacggcaacgggctcgtggggcggcacgtacttcgcgcacccgatcaacaacgatcgtctgagcacgaacggcgacgtcgcgctgaacaactcgatcaagtacacgagcgctaactacgctggcctgcaattcggcggcacgtactcgttctcgaacaacacgaacttcggcaacaaccgtgcatacagcgcgggtgctgcataccagttccaaggcctgaagctggcagcagcttactcgcaagcgaacctgggtgacggtacgaacacgagcggcgcatcgtcgatcaacgcacaaggccgtgtccgtacgtacggcgctgctgctggttacgcattcggcccggcacaagtcggtgctgcatggacgcaatcgcgtatcgacaaccaggctaacggtgttggcacgctgcgcgctgacaactacgaagtcaacgcaaagtacaacctgacgccggctctcggcctgggtgctgcttacacgtacacgaacgcgaaggtcaacaacggcagctcgcactggaaccagttcggcgttcaagctgactacgctctgtcgaagcgcaccgacgtctacgcacaagctgtgtaccagcgtggcgcgaagggcaacaacatcgtcggcacgggcatctacaacggcgacaacacgacggcttcgagctcgtcgatcaaccaaaccgcagcaacggttggtctgcgtcaccgcttctaagcgtgacggcggggtaacccgcttcgcagtatcgaaaaaggcgccttcgggcgcctttttcgtctgtggaacgaggtgtcggcgattcgcatcctccggatgcaaaaagcgaggcgtgtgcctcgcttttctcgttgtgcgtcgttgcggggcgatacccgccgcagatggctcagcgcgtgtattcgccgttggcttccggctggaacacgatcgcggcgaccttcatcagcttttcggcgccgctcggctgcatcaccttgaccatctggccgcgttgggtgcccaacagtgccataccgacgggcgagaagacgttcaggcggcccagttcgagattggcggcatccggataaacaatcgtccaggtggcctgttcctgggacgcttcgtcaagcagcgtgatttgcgaattcatcgtgacgacgttcgccttgatggcatcgggctggacgatgtcggcgcgctcgagcagcgtatcgagcatcgtctggaagcgcgagttgtgttcggcgtgtttctcgaggcgagcaacgtcgagttcggtcaactgataaaggcgttgtttcatggctgttctccaaatgatcggcaggggcaggcgtggcgtgcctatgaggatcgcccggagcctgtctgacctggctccgggaggagaccgagccgtcagatcaggcgccgggcaggggcgagcggcgcttgggccgtgcgtcgagcgagggatgcgccggatgaccggcgcgcgcacgcacgccggccgggccggacggcgaaaccgaaaggggcgtgagcgcgtacatggtggatggaagatcgattgacgaataaaaccttacgattctacaacacaaccttcggaatatgtgatctggccgtcggcagttcgtcagcgattgttgtgctgctgaagcaagttgtcgcgatatcgcccgaaaaatgtcgtctatttttgtcgaaatcgcaacgctgtatgttcaaactaagggtttccccttggaggtgcgagaactacactgcattcaatcgcttcagacagtcctgccgaggcgacgtcataagagaacatattccggaggtaaatcatgaagtcgatcatctacgcagccatcgccgcatccgtccttgccgccccgatcgcatcgtttgcacagtccgagcagggtttgacccgcgaccaggtcaaggccgagctcgtgcaactcgaacagaacggctacaagccgctggcgagcgattcgcagtacccggacaacatccaggccgccgaacaacgcattcaaccgaaccagccgatgctcgcgcaagccgacacgagcggctacggtgccgtggcaacgggtgccgggcaagccggccgccgcatgacgcgtgaagcaccgaaccccgtgaactcggtctacttcgggaactgaacaccgccgggtctgcccgagcgcaccgcttaatcgacgagacgcgcgccagttgagcgcgtcattcgcccgcaggagcagaacctccgtcgccgcattccggcggctttccgcccagacgctcacgcgtttgggcctttttgctggggcgggtcaggcggacgtaaccgcaggcgtaccgtggatatagtgttcgagctggctgatcgtgaactgctgatcggcaatcacgctcttgacgaggtcgccgatcgagatgaggccgaccagcttgccgccgtcgaggacgggcaggtggcgcatccggtgttcagtcatcagcgccatgcactcgtcggtggattgcgacggttcgacgtagcgcaccttcgccgtcatgatttcctcgacgcgggtggctttcgacgagcgatcctgcaggacgaccttgcgcgcgtaatcgcgctcggtgacgatgcccgctatgtcgtcgccgtccacgaccagcagcgcgccgatgcccttttccgccatcagcttgatggcgtcgtagacgagatcggtcttcgtgacggtatagatggtgcggcccgaatccggcttggccttgagaatctgcgcgacagtcgtgctcattcgctttctccgtgtgcaggtcgatgcagggcaggcagggcgtgatgcgtgtcacccgatgagcccagtatagccgcgcaggtggcggcagtcgcgtgacgattccagattagcggtaaactcccgtcacgcactatccacacaactcctacattcctgaacgtttcgattgaattcatgatgtcttcgcgtccacaatcgcccacgccgggcaatggccaggccgacgagtgcgtgacgctcgtcgccaccgcgtcgctgcccacacgctacggtacgttcaagtcgtacgctttccgcgtatcgggcagcgatgccgaacatctcgcgctcgtgatgggtgacgtcgccggcgagcagtccgtgctgacgcggctgcattccgaatgcctgaccggcgacgtgttcggctcgtaccgctgcgactgcggcgagcaactcgatcttgcgttgcgctacatcgcggccgaagaccgcggcgtgctgctgtatctgcgcgggcatgaagggcgcgggatcggcctgagcaacaagattcgcgcgtacgcgctgcaggagcaggggcgcgacaccgtcgaggcaaacctcgacctcggcctgcccgacgacgcccgcgaatacgactcggccgccgcgatcctccggatcctcggcgtgacgtcggtgcggctgatgagcaacaatccggcgaagttcgacacgctcgcgaagcacggcattcccgtctgcgaacgcgtggcgcttgcggtgcccgtgcgcgaggaaaacgagcgttatatccgcacgaagcagacgaagttcgggcattacttcgaagaaaacgagtaacaaaaacaggggctctccggagcccttgctccaactggctctcacacctctgagcctttctggtaaagggtttgagccgaaagttgcgtttatcgggtgccttgtctgcacttgacgaaataggcgaaaacttggcactctggcgtagcattttcctacgccagatcgaaagctacgctacggtctaggcctacaacaaaacctacgccgaccgctgatgagattcgacgcacgcaccgcgagcaagctgcctgcgggccaacacatgacctttgacggattcccgggcctccgcttccaggccagcgagagccgtcgttcctggatctaccgatacaaatccccattgacgaccgaatgcgccaggtgaagctcggcgagtggccggccatgggtttccctgcggcgatttctgaatgggagcaaaagcgagcggcgcgtgatgctggggccgatcctgctgccgcaaagcgcgagaagcgcgctgcggttgccaattcgcgcgccgtcgacgcatacactgtcaagcaagtgtgtttcgactatatgggcggctatctggagccgaaccgcaaggacaagggcgtgatcgaggttaggcggatgttcaaggcgatgctcggcccgatcgagagcgttccggccgcatcgataactcgtgcgcaggcgttcgaatttttggattcttatcgtgccacgccggcgctcgctgcgcgcctccgcatggagctgggcggagcgtgggactatgcgatggacgctgggaggctcctgatggcacgccgaactggtggcgaatgatcctgcgcggcaagcttcgcagcaaggggcgcacgatcgacggtgtcgccatgggcacaaaaagcgggtattgagcgaggatgaggttggcacgctgcttcgctggctgccgaatatgagcctaacggtttcagacgcgatcaccttgtatctgtggacgggcgcccgcggcggcgaaatcatttctatggagtcgcacgaaatcgccgacgaggcggacggcctatggtggaccgtgccgaaggaaaaaccaagaactcgtggcgcgcgaaagcagggatttgcgagtgccgctcgttggtcgagccgaggccgttgtccgtcgacgcaaggaccaggctgtgaacggctttctgttcccgacgtcgaccggcgagatgatgaagcagaccgtcatttcgcacggcatttactatcatcagccgtactgtaagcaggcgccgaatcataatcggccgcggctacccgtcacgcactggtcgcctcacgatttgcggaggaccgcccgaactatgcttgccgcacttgggtgcccgcatgatgtcgcggaggcggtacttggtcatgttcaaccgggtgtagccggcgtgtataaccggcaccactacgatcgggaacgtcgagagtggctcacgcgcctgtcgcagttccttgatgaactcgcgctgcgatatccgactaagtaatctgttgtgtaaggcgaggttagaccaaacggacagcgtcagatcgtctgactctgttcggccaagtgcagtcgtccggatctctgagccggatggccgcgatcgagcccaaagcagacgcggaaaggcatagcggcctcacttcgaatcctgactagggtcatcgagtggcgtgctcaggttttcggcctctggtatttgtacgtcgggatcgggttgatccagcggttgcgccttaattcgctccacataaccccagacaggttcaccagaatcaggtatacatttgattcgataaaataactccctgggattaaagccgctgagcatttccctgacaacatacgtatcgcccgcttcaagagcacgtatgaccttgctgtcccgcgctggccgttcgaacaagggctgtcccacgtaagcatcgggcgtttcataaggcttgtcttcactggctgtacgtgcagccctgatgtgctcatgttttctgcggatagcctcgattgtcaggtcgaggcatcgggacgcattctcgtaattcgaactgttttctgcatatgcggcgggaaggcgaatgtaccattccccatttatttccagccggatcgcctcgggagttaggcgcctaatattgttgaggatttgcgtgttgattccccactccatcgcgtctattcgccaagtttcatagttgatctggacgtaatcgaaaggagtttttacattatcccgtatccattctgcattgcgggtccagtaatgggctttccagccggtgccgagaagtccgagtcctagaaggccaccaggaataggcgagtttgcagtcgtgttgcgatagggataaatgcagtagtcgttttcgaattctaaaagaacgctttgcgcgtggcgatcagggttttagcatagtcgctctctgcgagagcagacacggcatcatctagaaagggccgggatatcgtgttgccaacgacctcaacgagaaatatttccctaagaggcttacccaccgccgaattcaaaaccgcgtcgatcgccactttggctgcactcagatgtccttggacagtcaatggctccatcacttgaccgtaatgcttcgcagtcacccttaacttgttcatcgctttgagcgtcccggactttggtaccttcatccctaactgcccaagcgctgaaatcatctcatcgaaagtaaacttctcgattgcacgttcttcgtccaactgtttctcaatcaagacagccagaaaaacaagttcaacggcatcctgaagcacgatcaatcctgcagtcgctagataacgatcaccaagcccgcattgtcgttctgcctgctcgaggagtgcgcgtgctgttatgagagtttgaagagtcgcttccttcacgatcggcttcagtggtcaggaggcaaatagaatgccacagttttcccgtagcccgaacggctgctacttgctaggaagcagacgtttgagctaagcaccttagcgaccgctccggggcgatttccgtcggttgctttcgattgtgagggcacgtatcgggccgtgcgagcgtacctggacaaccaagcggcgtaaaaacaacggggccggtggccctgcctctcaaacaatgcaccggcctgcgtatcggtttctacgcaacagccagtttcgcgcgctccgcaacgaaactcagccgatcgaagttcatgtttgcgccggacgtgatcgcgatgagcgtttcgttctcgatccctgcgcactcggcgtacagctttgcccctgcgacggccagggcaccggccggttcgagcacgctccgcgtatcctggaacacatccctcatcgccgcgcacaggccatcggtattgacagtcaccacgtcgtcgaggtgttcgcggcataaccggaaagtctcttgtccaaccagtttgaccgccgtaccgtccgagaacaaaccgacctccaccagttcgacgcgttcacccgcacggagcgactgcgccatcgcgcatgaatcctccgtctgcacgccgatcaccttgatgcccggtcgcacggctttcacgtaggtcgccacgccggacgccaggctgccgccgccgatcggcacgaagatcgcatggatcggctttgatgctggcgcaagatttccatcgccaccgtgccttggccggcgatcacgtcggggtcgtcgaacggatgcacgaacgtcaggttccgctccttctgcaatgtgagcgcgtgcgcgtaggcgtcgctgtacgactcccggcctgaatgacctcgacacgcgaaccaccatgcctgcgcacggcatccaccttgacctggggcgtcgtgagcggcaccacgatcacggcgtgcacgcccatgcgagccgcgcagaacgcaacgccctgtgcgtggttgccggccgacgcggtgatgacaccgcaagccagcgcatcagccggcatctgcgccatcttgttgtacgcaccacgcaacttgaacgagaacaccggctgcttgtcctcgcgcttcagatggatcgcgttgcgacaccgaaccgacaggttgtgcgcgaaatccagatcggtttcgatcgcgacgtcgtagacccgcgcggtcaggatttttgaggtaatcgaacggcgccgaaggatgggcggggctctgtgcgtgcgcgtcgaatgggtttcggtgcatgaacacgatgatttcctttccaggtcagggtggacaagcctagaagcggaaatgaaaaacccgcctcggcggcgggttttcgttatcgagcaagtacgcgctaacccaccattcggagaatggtgcgaataatcagcgcgatggcgatggctcgatgttccatggacactaggattgacgattatgggaatgctgtcaaccagcggcgcctacgctgaaagccagtcgcatcacgtcgggcggcggcgcgtccggcggtgtgcgttttcttcggtgccgcttgcgcatcctgtcgtggggcagtttcaacgtgtgaggtcaagcgcccggcggctttgggtgaagcgaacgccttggccgggctggccggtttcaaggcagcaaccacgcgtgcctgcacatcacgctcacccaccaggctggacacgtgctggcgcgggtgctcaatcgcggcgggtggcggtcggcccggaatggccatcgaggcgataccagaccgcccagctgagttgggtcggtatgcgctggtcaccagaggcagttgccggccagaagcagccagtcgggatgaaacattggcaggccgcttcgattgataaagcggccattcatcgttatctcttcaatcgggctgcgctgtcgagaatgcgtgtgccgcagccatcgtatccagtgcttcgcgtaacagcaggattttgccgtcgcgcgccaccagtcgccctgcatacaactggcgatagattttccccgtcgatggaacgagcgcttcgacttcatattcggcgaatacctgctcaggcgtttcgatcagcagccgcacatttctgaacgcaaaatccggcactttcgcgagcagcgaggcaatgaagccttcgatctcgctgggcccctgcgcgcgtgcgtcgatacccagcgacttgagatagggtagttccagcacgccatcgtcagcaaacagtgcgccggccgcgcgtgggtcgcgaatcgattcgaggtaagcaaaaagcagttgtttggcgttgttcatgatcggctcgataaaggcgttaacggatgcaattcattgcatacggcttgcgcgctcatcgtgattctcctttcgcgtgatgtcgtgcagccggtggaaaggagaatacggatcggacaatatttgcgaaacggaatcgtttgaaatccatcattgcatgaatgcaatgatggacgccggctgatcaactgcgccgatgcatcatttcggccatcgccaggtcggatcgctcagatgttcggcgaagtaatcggacagcgccgccaccttcgccggacgcgctcgcgccgacggcgtaacgaagtaaaggccgcccttcgtcaacgaccagtcggtgaggatcgcttcgagacgaccatcggccagatattcgcctgcgatgaattcaggcagttcggcgatcgccaggccatcgagcagggccggcaacagcgcatcggcgttggtcacgcgcagcgggcccgtcggcatcaccggctcctcttcgcctgcgtcattcgtgaagcgccatacggcgctacgcgcgcggtacgcgtacgacagacaggggcgatccgccagatcgcgcggacgggtgggccgtccttcacgcgtcaggtattccggcgacgccaccacgaattgcgtcaccgcgcacagccgccgcgcgaccagcgacgaatccggaagcgcggcgatacgcagcgcggcgtcgaacccatcggcgaccagatcgaccgacgcatccgatagatgcaggtcgatcgacacctccggatacgcgcgaaagaagcccggcagcaacggcgcgacccagcgcagcccatacgacatcggcacggccagacgcaccagcccgcgtggctgcaccgacatttcgcgtgccgagctttccgcttcctcggcctggcgatagatctcgccggctttctcgctgatcgtccggccgaactcggtgagcgagagctggcgcgacgtgcgattgaaaagccgcgcgcccagccggtcctccaggcgggccacgccgcgcgagaccgtggcgaccgacactccggtcgcgcgcgccgcggccgcaaacgacccgtgctcggccaccttcgcgaacatcgcgagcccctcgaaatcgggtagttgagccatttttcctcatctttgcatttatgcaacgtttgattgcgatcaattctatttcgaaaagatgaggccgtcgatattctcctcacatcgcagtacgccactgcgacgcaaacactcaccgacccaacgaaaggagcaataccatggcccgcaaactcgacaacaagatcgcactcgtcaccggcgcaaccagcggcatcggtctcgccaccgccgaacgcttcgcggccgaaggcgcgcacgtctatctcacgggccgccgacaggccgaactcgatgccgccgtgaagggcattcgcgaagccggcggcaaggcgaccggcgtacgctcggattccacgaagctcggtgaactcgacgcgctgtatgcgcaaatcaaggaagaacaggggcgcctcgacgtgctgttcgtgaacgccggcggcggttcgatgctgccacttggcagcatcaccgaagcgcactacgacgacaccttcgagcgcaacgtgaagggcgtgctgttcacggtgcaaaggcgctgccgctactcgccgagggtgcctcggtaattctcaccggctcgacggcgggtagcgcgggcaccgctgcgttcagcgtgtattcggcttcgaaggcagcggtgcgtgcctttgcacgcagctggattctcgacctcaaggagcgccgcatccgcgtgaacacgatcagcccgggcgcgacccgtacgcccggcctgctcgatctcgccggtgatgatgctgctcagcgtcaggggcttgccgattatctggctgcccagatcccgatgggtcggctcggcgagcctggcgagatcgcgagcgcggcgctgttcctggcctcggacgacgcgagcttcgtgaacggcatcgaactgtttgtcgatggcggccagcagcagatctgagcgtagccggggcgcacggggtgcggtggacgcggtcttcgacgatcgcgatccgcacccggcgcactcgaaccgagctccgtcatgatcgaacatcggccttttcttgcgcttggcgtattccggcgcggctgtgtcgacgcccgtcagcatttccgcatggtcgaatccgggtgcgccgaccatgcgccgctcggtccgctctacgtgtggaacgacgttgaattcgcgccgcactctggcctcggcccgcatgctcaccgcgacgtcgagatcgtcacgtgggtgcgttcgggcgcaatcacgcacgaagatgacacgggcaatcgcgcgcgtctggtcgccgattccgtccacgtgacgagtgccggcgctgcgatccatcacgccgagcgcaacgaggaaaacgtaccctcgcggcagttccagatctggctacgtccgcgcacacctgccggtacaccgcgctgcgcgacgcgagtctgttcgcccggatgtcgcgagggccgattcgttacactggcgagcggcgatccggaggatgtccgcgccggcgcgttgcccattcacgccgacgcacgtgtgcgtatcgcgacgctgcgtgaaggcacggcgatgcggcacgttttgccgatgcccggttccgcttatctggttgcggatcatggccgactggacgtagggccggtcaggctggcgcaacgcgatggcattgccattcgcgatgaaacgtggctcatgttgagggcgcgagacgacacggatgtcgtgattgtcgagcgcttatgctagggcgagtgctccatcggagcgtgccaccgccccattcattgcggtttcctgcttccagaaaacgcgcctgtgagagtgaggtggccgttctggggtgaactgcagacgttgatactgacgttgcctatggcggagatgggtcgatgacggcccttgaggaggtgacggcgatgtcaactcagatttgatctgatgctgaccgagagttcaggtcttggcttgcgcaagtgaacttgcggcgccggttactatggccggtattgggaggaggcgcgagatccgattcagggcatgcttctgcccaggcttcgacctcgcgtgtcagccacgcaactcgccgatcggagagaagccgcggcttcgggaatttgttctcgcgcaccagtttttggacggtcgcttccgatagcgagagagcggttgccactgctggcaggtcgaggtagagcggctttatggtggttgatgcgggcatgctacgatccctcagtctcaaaagattattgatgcgatgcaaaagaaatttgtgatgcgcgggtacgagatgaactgcgagccgcgcgtgacgatggacggcaaatttgcagcccaggtcgaagtgacgaagttgggatacagcagggaagccttccggaaccttggcgaattcggtaccgaggccgaggccgttgcttacgcaaagaatttttcggaagagtggttgagccggtacgcgtgatgaccgatctcccatgcagcgcctgtatctcactgcacggcgaatcttccgacatcgagccgcagcaccttgaactggtcggggtggttactcgaaacggaagcccgttcgaagagcactatcaatgcccggcgtgcggtgcttcgctgtcacgctcagttgccgccgtgcctgaggcacgcatttggtttgtggttgatggtttgcggcactgaacgcatgccccttccgcttccgtctcagtggcagatgcggcgcgagccttgtcttccatgaacgcttcggcgtcgtgcaataggtcctgacagtggacgtgcgccgcacgcatccgcttgatggcgccaaccacgattgcctctgcacggtcgaggagtgcagcccgctcgtgcgccgtctcgccgaccttgctttccgccgggcttgtcctatcgttcatttcctgtccttccgaccgctcggggccgcaatgaattgggtatgcatcaagtgccatcgggaagtgccgctggaatcgggtgagccgaatgtcgactcgttcggcatctacttcatttgtccgtactgccgccgccgcaatcagcttgagagcctagggcatcagcggggcgcgcttgtgcttcggcagacggggaagtagcgggcgagcgggagaggatggcgccgattcgctgcaccgcgtcctcgattccttcgcccggcgctgagacgatcggcgctgcggccgggttgccttcggcgtgcgtctcttgataaaggctgacaacgatctgcatcgcagcaaccacaggaaattcctcttcgatttcttcctgcgtcatgccttcgagcatcgagtcggagtcacccaagtgggtatcgagcaaatccatcacgcgacgcagttgctccttcaagcgcaccggcgctgctgcgggctgctcgacaggggatgcagcgagcagccgattccgcaggttgttcagccactgccactcgttcatgaccggcatcgaatctgtacgcttcttcaacgccgtcaacgcctgcaaacgctcggttatttccgtcagcgcatcagcgcggctattttcagtggtcgccatgatgtggtcctcaggtggtcaggcggcggccttgattgcgttgagcacgtcgcatgcgacaactggcggaacagcattgccaagcatgtgcatagcgagccggtgttgctgcggcaggatgtagttggtcggaaaggacatcgcgtctcggccttcttctttcgtgagcatctgcatccggtcgccgtcaatgacggcccagcgatcgcgcgtcgtgatcgtgccgatcgggcgcccgatgctgcggccggttacgcctgaaccactgccgtagtacggcgcgacgaagcggtcgccgtgcgtgcgccgcccattggcgatgcgcttgagcgtcgccgcggagcgacccggcttctcgatcggcgaccacttgccgacatcgaagtcgatgatctgcgccagtggcatgtgcggacgtgccggcagccgaagcatcagcgggcgagcgctgcgcgtgaggacgagcatcaggcgcttgcggtgctgcgggactccatgatttgcagcgtcaacgatgtgcggcgcgatctggtagccaagcgcctgcaccgcggcgagccatgccgggtagagctgccactggacgaactcgaccacgttctctactactccgaccggtggccggtggtattcgagcgcggatacaacggcccatgcagtcgagcggctggcatcgtgctgcgggttgttcgccgccttaccgcgcgcgactatgcccctgacaacatggtgccgcgagcaggatgtcgtgggatggagcagtagctcagttcgcctggtgcaagtcttggcacacatgggtggcgccaggatggttcgctgcatggatctcgacggccgccggccagtggttagcggcccacactacgtcgatgccggccatcgtggctccggtggaaaatccgccagcaccggcaaacagatcgatcgcattcgtcgtcatcctctaagtcagtggatcaagcctcaatggcgggtgctcggctgcactgggtagtcgagcgtctgccgttgaagccggggaagaaaaagaagggcgccaaacaggccgcccgcaagaagaaaccgcgcgtccgaggcaacggtaagtgcgcggtttgggggtagggtggtcgtgctacgattcgcaccaaaataaccggggtgcaatgaaaaacaggaaggtcgcgatcagcgtgatacttgggctaattgccgtgttcgtagtgtcctacttgggcgccatgatcggcggaaatggcaaatacgatcgaactgtcatggcgagttggcttcaagcggtcggagcgtttgccgcgatcgccggcggttttgcaggcgtgatttatcaggccaagatacagagccagcaacgagcactcgatgtccgtctgcgcgaaaaggaacttttactcaaattctcgtgacctcaaacgaggcaattcggagcttggacacattgtccgagctgttatcgcatgagagtttcatgaaagccgcgatttataaggcggatgcgaaacgaatgaccgcgcaagtgcagcgtacaatgtccaacctcgaagagatcaacatttcgatatctgatttcctgagatccagcaacgtacagcttgatcacattagattgcttttgcggctcaggagggagatcaataaatctctggaccagttgattggcgttgacgctccgtatgaacagctgtctccaactgaagtcgatttcggtccgttttcaaaggaaatgaagatggttcgcttcgaagccggtcactactccgtgcacatctgacgttatcaggcggcaccgactaagggactacgtgcagtaggtactcgcgcagcgggcggactcatcccattgttgggtagtggcgaggacaagaaccgctacgataagcacgccaaggctcttgagccacaggatcaaaagggctttcacgaccacactcccatcagcacttcgatcgggggcgacggcgccggcaagcagatagaagccggcgatcacgcacagcggaatcaatctcgattcatggtcatctcgctttgttgttttggcttggtgtaaccggtatcagaggatggcggtcagcgttgcgctgccgtcgctatgctcagtgcgaagcatcaacggtgctccgccgaaaagctcagggcgaagttcgcgcaacgcgttgctgaagttcttcggagcctcgaagccgttgccgagcagtgcggtcgtgactgcgagctcgggatcgtcgtcgctgggagtaaagaacgacgcaacgatcgggatcttgtgctccttgcagatggcgatgatctgcgtcatgagcggcgagatctgctcgtcgtagatctgttccttggtagcgatggtcatcgtggttccccttcgtgattacgtaggtcagtgcttcgcctgcttgtgcgtcgaccaagttcgaacgcagcgacgagcagcaaggcagcagcgaaaacaccaagaccgacaccgataagtagtgtggtcatagattagttatccaaaatatattgaggccggagagggcgatagcggcctgactacgctcaaggaatggcactgaaggtcaatgcgattcgatcagggtagtcgcacagcactcagggagggcgcctcggttccactacgaggagaccgtatgcagttacgggctatttagagccgccgcgccggcttgaggcgccctcactgaaagctgttgcatcactcgcgcgcccgactactcccggctgtgccggcttccggtcgcgcgaggtttgtgccgattacgacgccatcggacacgtgttgctggctgtcttgcatcaggctcgctcggcgcacagcggctttccgctgggtccgtcctgactcacgacgcagatcgcgccggccggttgctccgcgtgtgcggtcccggcttaccttcgactgtctggacgatgccggcacaacttcaccggaccgtctaaggagcgagccccgcagggcggcgcagcaatcggtgctgcgttggaatggatgatgggacatataagactcattgtcaagacgtttgtgtcccattgtgggactcatgagtctcgttctgtctaatgcggagaagtatcagctcgcgagcatcgtcataatccttttgcacgcctgcgtatggtctgctgccgtcgcgattgtgaggctcgaactagccgcgagatcgagctgtgaggcgctacgcgcggttgcgatcattgacggccgcacgtctagagggctaggttaaatgtagcgcgcatcagagttggtggctggcgcctgcaggcagaggatcgccgcaggtgacaaggctcgcgtccgttggtgcaacggtttgagggaggggactgggaagtgtcagaagtgaaaagcccgcgcagggcggggccaagcggattaatgcattctaggctgatcgcttcgagcgcttcttggcggggccttggggcgctgccgcaggcttacctagtgagggaatgcgaagccccaaatgcggatccactccagagtagcccatttcgtgtgcgatgcccctagccttgagggcgagtaacggaaatgcttggaggataaaagtccgaacaatgagctgatagtcagatggatcgacccaaccttcgcgttcagccttgaacaaaaattctgcacaaacgctgattgtgaaatgacttacgccttcctcgcctgtctcatcgcgaaaaccatcaagatggagcgtgatctcagcgcccgcgatgttagacggtgcatctcggtctggcacgctgatgtttggctctaccttgctgcgggtcaccccttcttctatttttcatcatccgggtctacgagccgctccgctttaatactgacgattctgtagtcccacagctgaaagtcctcaatctttagtgacgagctgcttttactgtttcgtgcttccatttggtcacttctttgtaagatgtggaatcctcagatgcgagatactcgatagtcgagtgcgtatgcgtatgattgtgctcgtgcgtgtgaatggttacgcttcgtgctccagtcaactcgttttcgagcgacttgcgcacaaggtcgtttaacgacaagccacgtcgcgcagcctcgatctgtgcatcgcggtgcaatgctggcgagacgcgaacattgaaggtgccactacacggtttgtcaggttcgacgccttcttctgcacatgcttgaagatagaactcgacagcctccgtgaatgccttacgaagttcactgaggtttgcaccttcatagttcacaagatcattgatgaatagaatcttgccgtgaagagtgtcatcttcgaggctgaaatctattgagccaacatatcccttgtgttcaaaaatcctatctttctctttcattcttcatccccgtctgccagcagtccgaactcgcgcagcttttccacgacgtctcgcacggagtacaccttcacgatagagcccggatgcggtttgtgaacgaaaatttttcgaccttcatcgtcgaagaatgttctgtacgagccgcccttcttagtttttccttgaatccgagacatttcaatagcgtgaccatctcatcccatgcgaggtctgccgggattcgagcgatccgcttgcgtagcttctctagcgtcgacacgaactatatgccatcaagtggaggggttgcaactgaactttagttgcagcttgttgctggtcctgtcccttaaagcggatttcaggcagcagtagtgcttgtgcagcgcggcgttaggccgacgtctacatcagcacggccacgtcggcgggcgcgcggctgggcggtatgtccaagttcttggcaggactatgattcttcgtcatttgtggtctcactctttgcggcgaatgtgcgcatggcaggggaattatagcttcccatcatgcatccttgcatattgtgagaaaccgccccgttgtgtcagacggacaaccgcagttgaaaggttccgcaggctagggctaaactactgtacatgcgtacagtgttctaagtaggtaagcgagggctagggtggatcgagagacgagcgtcggcagacggcggtgtaggcgagggatctggcgcgggtggtagaggcatggaatcccgccctagtcgggcggatcgtgcttgtaagggccgcctattcggaaactgagtgggtcgtcacgctgttgggtgagccgggcgtgaccctgacgaaaaacagaaagcggatcgtcgcgagcaattgcgcgctggcctacgattcggcgctcgagcctatccgagccgcggatcccgagagcgcggatagaactatggttgcaagtgggaagatttccactgtccttcatggggccagcaaaagctattgtcgcgatcagggccttgattgacccgagcacctgcggcgaaaggccggctgcatccgcattcacgatcacgtcgaccagggcaagtgcttcggggctgaggctttcccatgatcgaggcacggtaggttgctggctcagcgccgcgtctgtgcgcccaatcaggtccactgcgcttatcccgacagtcttggcgatgatgtcgacggtggaaagctggacgtctttatcgccagagcggacacgatttaccgtcctcgcaaagctctcggcgctttcaacgagcccgagcgtatgcgcccgctgagcaagttcgcgcccgctggcgaatttcctcccgtcaccgataaggccttcgacggcgattctcaaattttcgcgtaggtcactcatgtcccagagagtagtgagtaatgcgagacttatgtgtcttgtttgttgggacaaataagtctattattgtggtcatgaatgaactcaccctcatccgatcgtggctttgcgggaaacgcgggcagtgggcgcgtattgcttcggacgccgggctcagctcaaagacggtgcaacggatcgcccgagggaagtgacctcggtgagcctgcggacatatgtcctgctgcgcgacgcaatgctcgcccaacaacaggagaccgcatgaagcgcctgtacgcacgtctgattcggtggctcgcgctccgaaattcgaaacaccgtcagcagactcccgtcgggaccattcgattcgttgcgtcagaaatgtcggaatcgacccggcaaccggccgggtcatgtggcgcatctcgaaggacggctttcgcgtctttactcccgacgtaacactgccttcaaaagatcggtgcgatccgccagcagcgccctgagagggctttcgaacgactcttggtcgccagacgacggcggagctgccaagaagtaggaaacgctgtcttccagcgcagtttggttgaagccgggtgagtcttgaatcgacgccttgagcgccgtcagtgcggcgagtacgccgtagcggaagctgtcgagttcgtgaagcagttgctcgtttgatgtggtcatgcgaaccccgttgtgtggttgttgaagaagtcagagccttcgattctcgcatagtggtggttcgcattcagttgtgatgtacgcagtctagagatagtggtgttccggggcattcccggatttttgaatgacggggaatagcgatgaacgtagtagcacaaccgatttcgttttcaggctcgcgcagcacgccgatcgtcgagcgtctgttgagggaggcgatggcggacccgaaggcgaaggccgcgatcctcgaggcgaccggctgggacgcttcgatgccgtcgaaggtgttgagcaacggcgccggcatcacgctcgagcacctgaatactgttttcacggcgctcggcctggtcgtgacgacgaagggttacatggactatctcgcaaagggaacgtgatcggcagcaactgccactgcgcgcgaggggttcggggagtgcggcggccgctaatctagagggcggacctcgccaaaagcgttttcgacggagagctcttttgtcagggtttagcaatcctaaaaatgtcgaaattatggaaacgaaacagaccaaccaatcggccgatacgcgacagcgaaatctggccatgtccgaagaggtgaagcgcatcgtgcgcgacaccaaccaacacccgacgtatccgcgcaagtgcctgtcgtgcggtgcagtcgaatctctcgacggctcggtgccgtgcggtcactgaaatggcccgcttccattgccgctgccggcactgcgagacgcgccgggtgctgaagaagcgtcctgacgagtacgtacggcagccgcaatgcaacgtctgtggccggcgcgacttccgagttgatgcgtggatgcagaagcggaatacgcgcctgatggcttgcacgtgcgctggttactggttctggcatcggcgaggttcgctgtactgctggcgccgagaggatggctcgacccgatcacctggcgatcccgattttgcggatcgcaattcgccgcccgacgcgttggcggcctgaatctcttctggaggaaacgtggcaaaaagctccgttgaagcatatggcgcgaagagcaaggtaactgcgctcgcgatggacccgaatgacctcgagctcgttgtcgactcttcgcatccgctgtacgaccgtcgagtgcatcaagagccgaacccgaagacggtactgaactatcgcgcgatcggtgtgcgcgagccggtgctgttctacaaggatccggaaaccggcaagaacctggttatcgatggccggacgcgcgttatcaatgcccgtgagctaaatcgacagctgattgccgctggcgaaccgccgatcacaattcctgcgattccacagaaggtcatcaacgacggtgggaagtcattcactgccgtgatggtcagcgcgaatgagatccgccatgaggactcgccgatcaatcgtgccgagaagatggcgcgcatgctcgacgtcggacatacggaagaaaccgtcgccatccacttcggcgtcgaggtgccaactgtccgccagcaactgaagctgctcgattgcacggctgcggtgcgtgatgcgctcgaagcggaccagatcaccgtgtcgaatgcactgaagctcgcgaagctgccgccggagcagcagcgtgagaaggtgaaggcggtcatcgctgcagctgacggcaaggagggacacgagcgctcgcgcgcgaaggcggcgctgacgggcgatgccgctccgcgcatgcgtactcgcaagcagatcgcggccgaattgacgaacgccactggtgagcgtgcagaggctctgcggtgggttctcaacctggcagatagtgagccgggcgcggaagaggccgatccgcgtcagttgtcgatcgacgaggctgcatgagcatcaaggtccaaacgatggtgtgggaccgctatccgggcgaggaccatgagctattgctcgccctgaagctggccgactactgcgacgacaacggggaacatcttcccgagcatcgaaaccatggccgagaagacgcgccggtcggcgcgtgcagtgcagtaccagatcaagaacatggtcaagcgcggctggctcattctcgttgcgaacgcaagcggcggccgtggccgtgcctgcgaataccgcatcaatcctgactggataaacggtgcagagattgcacccatttccgctggctcaaagggtgcaacggatgcacccatcgaaaagggtgcaacgagcagcaaaagggtgcaacggacgacggaaagggtgcaatgggtttcgcaaagggtgcaacggattgcacccgattcaccatgaaccaccacaggaaccgtcagagaaccaccaaggcgcacgacgtgcgccgcgagttgcgttgcatgccgagctgcgttcgatcgaattgcccgactggctcgcgttcgaggattgggacatgtggtgcgaacaccgtgaggcgaagcacaaggacgccccgtggacgcgcccggctgcaaccgtatcgatccgaaagctgacgaagctgcgctcgctggggcaagacccgaaggcgtgcatcgaagaggccgtgttgcggggctggacggggctgttcccgctgaagggcgatgtggctgcaacgtcgtcgggctccgacaccgtgatcgctccggactggtggaagacggcgcctggcattcgcaagctcggtaagcagcttggcatcgaagagaagccgaaccaggttttcgagcagtacaaagcgaaggtattcaaggcggccggcccgggcgaatggatggaagacatgctgagcacggtcagccgcgaaagcgaagagcgctacgaggccctgtacgcctacttcaacgacattccgcgtgatcagggcgcgcagcaggtgggcgcatgacgaaacgaacatcttggccaatgcgaatcgacgcagatgcaacgaccgtgggaacggctcgcgtgcgagatagctgggccgtcggccgtagctctgctgcgcgacaaatcgccgagcatacgggcgttcagccgccgtcggatttcgacgacatcgcgagcgggtttaatcccggcgctccggtgccacattcgatgcagaagccgaagcatccgccgaaataccgcaacaggaaatgcgagcacgaaggcatccgattcgacagcgagaaagagcgcgcgcggtatttcgatctcgttcgaatgcaagcggccagcctgatccgggatttgcggcttcaggtgccgttcgtactgaccgagcgcatgcagcgcgacgacgggacatgggagcgcgcgtcgaaatacgtggcggatttcgtctacatcgactgcaagacgggaaagcaggtggtcgaggacgtgaagtcgccgatcacccggaaaaaccaacgtacatccagaagcggaaaaccatgttggcggtgcgcgggatcacgatcaaggagatgtgatggctgttgaaaaggtggggaaggttgggccggcctcgaaaaagatcatcgattgcgtgaaggcaaacccgggtatccatgccgctcgagccgcgcgaacactgggcgtcacccgggtggtggattccggtcgaccgttcggaagctgatttcggacggctatctctccagggtagaagtggatggcgttccgcgcggcctgtttcacacggctctgccgctcaagtacaccggcaagccctacgaggggatcaacgaaggtcgcttctcgaagcgttcgcggcaaattcaagagcgaatcgcggcacagatcgagagggaacagcgactggccgaatcggctgcgtgggccgggaaggcaattcgcgcgatggtggacgccgggcgagcagccgcatgaagcgatccgattcaagccgcgcacgaaaccgatgtcgcgagggtcatggtcccggaaaagctcgccgctgccggaacaagcgccgcgaaaggctgcaatgaagcgccggactaagcggccgacggttgctgaaggctcgaagtatctcgcggcttgccgcggcgagccctgctatctgcgcgtgccgggtctctgccggctgaatccgatggacgacacggtggtgccatgccattcgaaccaatggcgacacggcaaggcgggtggtcagaaggcaaaacacgaattcacggttcccggatgtggcgcttgtcacgcgtggatcgaccagaaccgcgtgggcacgccgaggcagatcaagttcgatgtttgggatcgggcatacgaggaatgggagccagcgcgcgcccgaaagatgggagaggcaaattgccagtgaggatgtgggttcatatcccggcggggattagtagcacaccgcggaagcgcggcatgggggcgatgatcgtcacggagatcacgcgaaagattgatgcgacggtgtttcgactggcgcgcattccgaccgtgaagaggcaactggtggcagcagtcgcggcggacgtgttcattcctgaaatgtaccgggcgcagatcgcgaagagtgatccgcgttgggtcgctccgggcgtgttccgcacgaaggtttattgggtcgacaaccagaagtcgcgcgagctggggcagttcctggcgagcggtgcgttggtactggacttgagggagacgcgatgacgccgactgcacagaggaagcgcttggaaggtcaggcgacgatcgcaaagaaggtgttcgaggcagttccgattcgttccgcatggtcgatccaccaaatgatgtcgcacctgacgaagatcacgaagagccacatcgactaccgggtgatgcaaggctgcttgaacgccctaaaggattccgggttggtcagggagccggagcggggatgcttccagcgcgtcgaggtgcgcgaggaagcagcgaaaaccgaagtgaatggagaaattgacgtgccaaaccagaagaccgaatcgaaatcggccgcaccggccacgacgggatcgccgatcgacgtactggatgggattgcaggccgcctgcgccagttgcgagatgacgcggacactctggcgtccgacatagagacggcggcactcgtcatcgcggagcaaggggcggagacacaggcggccgtaatgaaggctcgccaactgcagcagctcttgcaggagttgggaggtattcgggtatgagcgacatcaagattagcgttgcccgctcgaacacgacgacgcatcgggcggtgctggatgagcgagagatcaaacggattcttgccgaaaaggtgtgtggactcgtgggcgttgcgagcgttgcggatgctgtggaggtgaggatctacctgtcgagtcggatgggtagcggtgggtcggagcattcggcaaccgtggaggtgacgatcgaccacgacaagatcgcaagcgcgggtgaagcatgagcgccgccgcatgcatcttgtacagcgatgtacccgaacggctgttgatttcagcgattcgccaccgtgacggcgtaaccgaagcggatctcatcgcgttcgacgaatgcccgttttcggggagatcaccgagacggagcacggcacgcaaatcgcgtttccgtggccgcgcaaccggacgatgcgccatgcgatcggcgattggctcacgcactacggcatcaactttacggtcgtcatgtaacgacgaataaccggtatctcaagcaaatcgaaaacagggatgaacatgacggtcgacgaaagcaaccagatcgaagagctgctcgacgaatggtacgactggcaagcagggtatgtgccgagccttggttatgggcggatcgatccgtcgtgccgtggcttctctgaatccgagcatgctcctacgaccgacgagcggtcggaagaggcggatcgtaaggcggcgaagaagcgtgcggaacagattgacgtatgcattgacgctctgacatggcaagagcgcgcagcgatccagcgacacatgaaggagaagcgaatcggtgcaatgaacgaggcatgcggtgcaaatgtctggcgcaatccgcgcagactcgatctgtcggacgcgcatgcgagctaccaggcggcgaaggaatctctgtatccgcgtgtgatggcccgcggcctgctgaaggcgctgcacgcggcataaaatgcgtaaggctagacctgatctctcgctgtcggcgactcgtcatcgagggcggtgatcgacccgaagcagccgttagataaccttcgcctttcgtctcttcaggaggataaagcagtcatagttcactgcccgagcgcggttgcaacagtgagtctttgccgttaatgccgttcagttaggaacctcaactgagctcagcacctagatacccgcagtagatgatcgccgggtagtcctgagtggaaaattttgcttgccgtgtccatggatcgacaaatgatcctcacgattagcactgaatatcccacggatcagtccgccgggagacttcgctcatcgcacgttgctcacatcatccgtcaggctcagatcgggttaatacgtctaacgacttttaccgtagcgtgcagcatcgtccagtgtgggtaccttggtcacgtgagttggcgcgtcaaaagtaggccacacggtgttacggtttcgtggcgacacgatccacgccgggaagcgaaaggcgccagcaatgctggtttcgacaaaccggtactggctgctcggcggcagtaccaagcaggccgcgtggttcttcttaccatcgggatccagttggcaggtgttgtccagggccggagccgcaaattagatgtgtagtccacctgtccacttaaaaagatggcggattcgttaaggttctcgactagataattcttgtttccacgtgggtccagaaaataggtcacgaatgaatgtttgattagatcctcgccgtacggaagacgcccgtctaacctcgttgctaccctgtggcggatggccagttccctcgccgcgtaataatagcgggcgcttatgaggctctcgcgcgtccgcgtaggcagcattaagatcccgcagatcaaggttaagaccgcgcagcgcggccttaagctccagtaagcccggtctcgccgctccactggtcacttcaccgtaggccgtgttatagatgttgttgatgccattcatagcggccgggtaagcctgccgggcagccatatagtttccggaaaccactgcggcgacaaaatctgaaattgctggagacgctttatcgatagaggccgcgatatcggcgaagcttgcgccagtccgagcgggattgcctgtatctctgcgattcgctgttgtacggcattaatcttggctaggagcgcatccctgcggactgtgtatagctcttcattaagcgtaagttccatcccggctagttcaagcagttgctctgcgttggcctcgaacacatcgaccaaggtgtccactattagcttgcccgtgatggccgctgtcgcatcgggatttgctacgctaaaggcgcccgctgtgtgggaaaaatacgcggaagccaagttgccgcttgggctgatgtccaggtcagagagtcgttgtaccagtccggaaatattgggagaaatttgcatgtatcgagtacgggctagatcgtcactaatcgagctgaatggttctatgcttgggatagcggatatctgctggcccgcaacctgccgtgcgagctgctcggcccatgtacgattggcagccaaggcaatgcgcgaaaggttcgaccgtaaaaattcctgcatggagcggtgctcaaccgtatggtcattacgcgcccgttccaccaagtcccgtatgtccacggacggacggccatcgttgctcagcgcgaaagcgtcggcgcgctccagcgcttgtaacacgctcgcgtgtccgaagttcagctcaccggtcgtgcccatggcggccgctgtgtgcttgcctactgcggcacgatcgcagatgttgtctgaaacgccggcctgtacctcgcgggcatcaagtgttctatagactgcaatcgggccggaggggccgccagcaacgttagcggcttgccgcagctgcgcctgttcggagtcggaaaagggattcccgatgtgatagagacttactttcccagcgtcgcccccggcaccgggagccgctaagaccgctgttgacgtaggcctcgtcggcgcagtacgggccgtgctccccacgctgctacacaatggaaccgagcccaagctgccttttccaccacgcacaccgccggcctgaaaggcgaagggcttgattgagttgggggcgcgcaaagttcggacgggagggcacccctgccgcaggccatcagcaatttcgatatttttggcaaatacgatgatcgaaccgctttgggccaatcctcgatccgcctctggaatccgtggtggcgggctgccatcaactatctcaaacaaggatgggaagcgtatcgtgcctccgctggggaattccggtgcgtagatggtttcgccaatctggacgccttcaggattatcccggtaatagctagcaaggaagcgctcgtgagcggagccgatggtctgactgttgcggtaatatcgcttgcggttcgcgatattgaagtaaattcggctatcgatagatgctctaacttccagccggttggcgagaatgagaacatctccccgtttgagcgcagcggggtagctattgtgatgacatcaccaacgcagaggatatccgccacatggttgcgcacgatatccgagtaggcatcctcacgcgaggtcagcggagcgccagacggattcaagattggcggcgccctggctggtcccatggatccataactagctccccggaatagtacttttcgaaaccggaacgttctgtccgtcgaatcgcgtagcaaccagtgggcagactttgcgttgtctcgaaggcaccgttgttggtcaccggctcactggcgaagacgactgggacccttaacgtgagaagtaagcacgtgaacgtcgctgcccacggaaagctggacatttgcatggtctcactccggtggttaaatctcctccctgtaaggtcgttgtagaagaccgccgtcacattgacaagtggtagtttgaccgagctcggctcaagctgtgtagccacttcttacatggcgacagatgaatgcgtgaacgagcatcgcgggcgcagtagcctccggacgaaagccgcgtttttcggcatcctttcccttgtcgcgaagtcgctgttcccgcagcatcacgaaatcgagcgcttagatcgccccacacacaaagtgcttgtaaacccgttctagtttcgctatattgacgacgtcgggcgcgaggtgcgcccaaatgaagcccgccggatctccgcgcgggctttttgaggagcgcacaatgccaaaactgccaatcgtcttcactatggtggtggtactgactgcatgtgtcagcaaagatgatgcgcagtggtcgcttcgtggttatccgattcacgacattaaggtcggcggatacgtgcccttcgcatgcggcgagtcaaagcgaatggggcgccgctactctgcgactgacaacaaaaccggggctcacgttgaaggcgtagtatgcgtcaacctgttcaacaacattactgatatcactcaggtcaaggaaagcaagtagccgctctagccatatgattgcaagcccgcaaggtgaaaaccttgtgggctttttcattgcgcgctgcatctgtaaaggttcttatgccagctcggccaatgaaaccctgtaagcaccgtggctgtggggtgctcgtcgcggccggcaaaacccactgcgaccaacacgcgcacgaagctgtcaagtggaagcctgacgccgtgcgtggaaatcgccatgctcggggatatggaagtgcatgggaaagaaatcggcaacgcattttgcgtcgcgacagcggcctttgccagccctgcttgctagccggacgtgtgacggcggcaacggaagtagaccacgttatctcgaaggcgcgaggcggaaccgacagcgatgagaacctgcaagcgatttgtcgcaattgtcatgcgacgaagacggctcgtgagcggttgcgttgacgcggggcgggcgcgctcggccatcggccgcctgcggatctggcgggagggaggggtgaaaaagtctggagggcgtcgtcctagggaccgcccgcttcgtcgagtttttacgcccgcgaaattaaaaattcaggagttggccagtgggaggaatcgcgtcagtgccggggcggggcagaaaacccaagccgaccgcacggaaaatcgctgcgggaaatcccggcaaacgtgcgctgaataaggacgagcctgatttcggcttggtcacgaacatcgagccaccggagtggattgccggtgaggcgcgtgacatgtgggagcgcgttgttccgctgctttgcgggcaaaaaatcttgcaagtgaccgacctgcacattgtcgaaatcttctgtgcagcctatggcaactggcgcactgctcaggacgagttgactcgcaacggccctgtcgtcgacagctcgcaaggcagtccgatgaagaatccggccgcgaccgttgtgaaggaggcggcggcgcaaatggcgagcttcggcgcaatgctggggctcgacccggcgagcaggcagcgcctggtcggcgcgaagccgaaaacacccgacaaccctttcgcgaagctgctcggcaaatgattggaagacatggcgacgaatttcccgcgcgtagagcaggggctcaagttcgcgcgagaagtcgttcgtggcaagcgcatcgcttgccggtatgtgcaacttgcttgcaagcgccaccttgacgaccttgcggcgagccgaaagagggatttccggtggaagttcgatccggaagccgctgagcgaaagctcgcgctcgttgaactgctgccgcacacgaagggcgagtgggcgttcaaggggcaactggtaacgcttgagccctggcagaagttcggcctgatggcgaccttcggatgggtcaacaagcgcaccggcaagcgccggtttcgcgagagctactgggaggtgccgagaaagaacggcaaatcggtgatcgcggccggcgtcggtatcgggatgttcgtgctcgatgacgagtttggcgcggaggtttattcgggcgcgacgtcggaaaagcaggcgtgggaagtttttcgcccagctcagttgatggtcaagcgctcaccgatgctggtcgattcggctggaatcgaggtcaacgcctcgaacatgaacaagccggccgacgggagtcgattcgagccgatcatcggcaatcccggcgatggcgcttcgccttcgtgcgcaatcgtggacgagtatcacgagcacgatagcgccgcactgtacgaaacgatgctgaccggtatgggcgcgcgtcgtcagccgctcatgttcatcatcacgacggcaggcgcgaacatcgaaggtccgtgtttcgacaagcgccggcaggtgatcgaaatgctcgaggggacggttcccgacgacgagcttttcggctggatctggacgatcgacgaaggggatgattggactgatccgcatgtgctggcgaaggccaatccgaatatcggaatctcggtctatcaggagtatctggagagccagcagcagcgcgcgatcaagtcggcacgcttcacaaacacgttcaagacgaagcacttgaacgtgtggacctcggcgaaggcgggctatttcaacctcgaagactggaaggcatgcgaggaccgctcgctgacgcttgaacagttcgaggggcaagacagcgtgctcgcgctcgatatggcgcgcaagctcgacttgaacagcatggctcgcctttttggcgcgacatcgacgggagacggcattacttctgcgttgcgccgagattttgggttcccgaagacacggtgcgcaataccgagaaccgccgtatggcggagcggtatcaggcgtgggtcaatcagggctttctgcttgaaacggatggcgcggagattgactatcgcgacattctcgaagaggcaaaggatgcgaaccgaatatgcccggtgcaatgcacgccactggacccgcacggcgcgacgaacctctcgcatcagctcgaagacgaagggctgacgccagtcacgatcgttcaaaactacacgaacatgtcggacccgatgaaggagctcgaggcggcgattacgtcgggccggtttcatcacgacggcaacccgatcatggcctggtgcattagcaacgtgatcggcaagaatctgccgggaaatgatgacgtggtacgcccgatcaagcagggcaacgacaacaaaatcgacggcgcagtggcgctgatcatggcgataggtcgagccatgctggccgatcgagtcaattctgagtcgatctacgatcaaggagtgggtgtttgaaatcaattgctattgcggcctgggtggccggcctgctcggttttgcgctgctgatcacgggggtagtgctgatcagcctgccgatcggcctgattgttgcgggtgtcctgcttctgttgtgggcgctcttggcggatatggccgcggctcgtgcgcaacgagtcgggcagccgaaggagtagcccgatgttcttcagtaggcaattgctgtccaattccggtcaaacccaaacgggttctggcggttggttgtcggcgctgttgggaagcgcacgatcggaagcaggtcaggtcgttacgcccgcgagcgcgctctcgctgacggtcctgcaaaactgcgtcacgctgctgtcggagagcatcgctcaactgccgatcgagctgtatgagcgcgctggcgacgacaggaagccggcgactgaccatccgctgtattcgatcctgaaataccagccgaatccgtggcagacgccgtttgagtatcaagagcagtcgcaggttgctgtcggccttcgcggcaacagctacagcttcatcgatcgcgatcaggacggcgtgattctcgggctgtatccgctggataacgaggcagtgacggtgatgaagggttctgacctcatgccggtctatcggatctacggggccgaaccgatgccgcaacggttggtgcatcacgttcgctggatgtcgatcaatggctataccgggctttcgccggtcatgcttcacgcgaacgcaatcgggcatgcgcaggcgatccagcagtacgccgggaagtcattcatgaatggcacggccctgtcgggcgtgatcgagcggccgaaggatgctccggcgctgaaggatcaggcgagcgtcgatcgaatcacggacggttggaatgcgaaattcggtgggtcgggtaacgcgaagaaggtcgcgttgttgcaggagggtatgacgttcaggccgttgtcgatgacgaatgtcgacgcagcgctgattgatgcgcttcgtctttcctcgctcgacatcgcgcgaatctacaagatcccggctcacatggtgaacgagctggagcgggcgacgttcagcaatatcgagcatcagtcgctccagttcgtcatctacacgctgttgccgtgggtcaagcggcacgagcaggcgaagacgcgcgatctgctgttgccgtccgaacggaagcagtacttcatcgaatacaacctttcggggctgctgcgaggcgatcagtcgtcgcgctacgccgcttatgcggtcgggcgccagtggggctggctttcgatcaacgatattcgccggctcgaaaacatgccgccggtcaagggcggcgacgtctacctgagtccgatgaacatggttgacgcgtcgaagccgcagcaagtatctgccgggaagaccgagccgacgaaagcccaaatcggcgaaattgagaggatcctatcttgaaaccgcacctcagacttgcaagtctgattttcaaccagccgcagctcgtcacggacccgatgatgtcgctcgcggttcagtgggcgaaccaggcgctgaacctcaacatcgtcaacctgaccgtgaacggcgtacagccgaagatcatggaggacgacgagttcgacagtggtgcacagatggctgcggcgtcggagcgtcgccgtgttctggtggccgataccggtatggacatcattccggtgtcgggaatcctggtgtcccgctcggcgcacatgaacccatgcgagccgatgaccagctacgagtttgcgtactgccgtgaatcaggcggctgcggatccggcagtcgaacatattgtcctcgacgtcgacagcaacggcggcagtgcaaccggtgcgttcgagctggctgacgatattcgcgctgcctctctggcgaagccgattacggcgatcgtcaatttctcggcattttcgggggctacttgatcgctgcggcggcgtcgaacgtgatcgtcagccgcacgtcaggcgttggctcgatcggggtgatcgcgaatcacctggacgtgtcgaggcgcgacgaacagcagggcgtgaaggtgacgtcggtattcgccggcaatcacaagaacgacctcacgccgcatgaaccgttgagcgaccagtcgatgcagtttctcaaagacatggtgcaaaacagctacaagcagtttgtcgacgcgatcgcgaacttccgtggcttgagcacgcaagcggtgaaggacacgcaggcgggcatcttcttcgggcagcaaggcgtcgacgctgggcttgcggacagcatcgagacgccgcaggcagcgatcaaccggattgctgccgaagtgcgcgcatcgcgagccgagcgtcagagcgggagcgctcgacgcagtgtgtcggcacgtgctgcggcaatgaacatgcaatccatgatttaaccagtcgcaataaatcgaattcccacgatcaacatcagagcacgttcgcgtctcagttgagcactgccacctccgggtggcacttttaggagaagggtaagtgaacatcaatgaactccgccgcgaacgcgctgccatcaaccagcgagttcaggcgctggcccagatcgagttgggcggtaccgcgttgtcgggcgaacagcaagccgagtttgaccagctcagctcgaaattcaacgatctgaccgcgcaaatcgagcgtgcggaagccgcggagcgtatggctgccgccgccgcagtgccggtcgatccggcgccggctgcggttactgcgccggctgcgacgtccgtgcccgcacagccgaaggttccggaagtgaagggcgcgaagatggcgcgtatggttcgcgcactcgcggcagcgcgtggtgacacgcagctcgcgtcgaagatcgcgatcgagcggggtttcggcgaagacgttgccatgtcgctcaatacgctttcgtcgagcgcgggcggcgttctggtgcccgagaacctgtcgagcgaggtcatcgagctgctgcgtccgaagtccgttattcgcaagctcggcgctcgtacgctgccgctgtcgaacggaaacatcaccatcccgcgcctgaagggcggtgccatcgtcggttacatcggcgcagacaccgatattccgacgacgcaacaacagttcgatgatctgaagctcacggcgaagaagatggccgccctggtgccgatcgcgaacgacctcatcaagtattccggcgtgaatccgaacgtcgatcagatcgtggtcggcgatctgacagccgcgatcggtgcacgcgaagacaaggcgttcattcgcgacgacggcacggcaaacaccccgaagggcctgcgcttctgggcgattcccagcaacgtcatcaccgcgagcgatggctcgacgctgcagaagatcgaaacggatctcggtaaggccattctcgcgctcgaaaacgccgacgcgaatctgacgcagcccggctggatcatggccccgcgtacgtttcgcttcctcgaaggtctgcgcgacgggaacggaaacaaggtctatccggaactcgcaaacggcatgctcaagggctatccggtcggcaagacgacgcaggtgccgatcaatctcggtgacgccggcaaggagtcggaaatctacttcaccgacttcggcgatgtgttcatcggcgaggaagaaacgctcgaaatcgactacagcaaggaggcgacctacaaggacgccgacggcaacatgatcagcgcattccagcgagatcagacgctgattcgtgtgatcgcgaagaacgacttcggtccgcgtcacgtcgagtcgatttcggtgctggccggcgtgacctggggcgcgtaagcgaactcgtaaccgtgcggctcgatccgtcgtgatcgggccgccgttcgagaaaacatgaaggtagtcaagttcaagcggcattacgcgcaatacacgcctggcgatatcgcgggtttcgaggacgcgcacgcagaccggctcgtcgacgcggaaatcgcggaggcatctgtgtcggagccgaaggaggcgaaagcctcgcagagggtcgacacgggtaagcccgcggcaaaggggtaatgccagatggccgctgttctcatcgaatacctggacgacgcggagccgcttaccttcgaggatgttgcaattcaatgtcgaatcgatggcgacgaagaacgggagttcatagagcacacggtgattcccggtgcgcgtcacgcggccgagcgcaagtctggggccgcgatccgaaaggcgcgctatttcgagcggctggcgggcttcccgagggggacttcccgttgtcgatcgggcaagttctgagcgtcgacagcatcgagattcgcgatgcaacaggcgctgcctcgacactcgacccgaaagggtatgagctcgtccaactggggcgagaagcgtggtgcgcggttcttggatccgctgactggccacacgctcgagcagtgacgatcacgtatcaggctggcgtcgacatcgacaagcatccgtcggtacggtcgtggatgttgcttgcggctgcatgggcctacgaccatcgcgaacttttctcggaggggcaaggagtcgcgcagatgccggaaggttattcggacctcctgctcgattcgatcaccgttccgccgaggttctgatgaaggccggaaaactgaaagagcgaatcgtcatcgagcggcccagcggggaagaaaacgagaacggcgaaccgctgccgggggcgtgggtggtgcatgcgcggccgtgggctgacgtgttgttcgtgaacggaaaggagcacgttgtctccggagcgattcgcggcgccactgtcgccagcatgcgcattcgctatcgggcagggatcgatgagcagatgcgagtgcgttacgacggcaggctgtacgacatcacggcggtgctgcccgctcggacgcgtgggtatctcgacctgtcggtaaaggtgggagagaagtatgtctagtgtccagattcttgggctggcggatctgcaggccgatttcgccaagctcgcgaaggcgcagtcgacgaaggcacttcgacgcgcgacgttggcgggcgccaaggtgatccgagacgaagctcgtgcgcgagcgccgaagaagaccgggaagctaaagcggaacattgtttcggcatcgctgcgacagaaggaatcgcctggtgtggcgactgcgggcgttcgggttcgatcgaagggcaaggaagattcgccgaccaacgcgttttactggcgattcgtcgaacttggcacgcagaacatgaaggccgatccattcatgcgtccggccttcgacgcggcgattgcccaggccgagggcgcgattcgaaccgagatcgcacatgcgattgatacggtgatcggaggtggaatatgagcgcgctgatcatccgcgacgcgatcggggttgtgggtgccgcgaagggctatgtcacggtagccgggtcgaaggcgcaatcgccgtactacgtcgtgtcgcgcgtcagtggtgggcgcgatatggcacttggcggagcgaccggcggcaagtcgggcatgtatcagatcgacgtgtacgccagcacctatacggaggccgatgcgatcgccgatcaggtgatcgacagggcgtcgtcgagcgggaagttcgccgttggtggcatcagtgagttgcccgacgacttttcgagcgataccggagatttccgggtgagcctcgaagtatccgtgcagttctgatcgattcaatttctgtttggcccgcgagtgcgggcttttttcattttgaggggcttatggccgagaagagcaagcgcatcaaggcgcaaggtacgaaggtcgagatctcgaaaacgtcgtcgtcgaacctcgatgacgacaatctcgtgtttgtcgatctcaacacgacgagcaagacgatcaactggcaaggcgggcaatcgtcggaaatcgacgcgacgacgctcgccagcgacgaaaaggaatccgagctcggactgcccgatccgggcgagttttcggtcgacggcaactattcgtcggacgatgctggccagctaattcttcgcggcgcacgcggcacgggtgacaagtatgtgttccgtgtgacgttccgcgacaagtcgcaattcctgttcgtcggcatggtgcgccagtacacctggtcggctggcgtcgacggcattgtgacgtcgacctacagcgtccgtgtcagcggctcgccgaaggaagtgccgccgccggctgcgccggcgggttaagcgatctgaaaaacgtgaggaaagagtgatgacaaaaactccgacggtcgccggcgcactgcgcgccgcgattctcgatccgctggccggctggcggcatgagctggtccagatgccggaatggggtggcgtgacggtcgcggtgcgcgaaccgctgctcgaagaccgtgcattctggctcgagccgcttcgcattgctgccggcgtcgagcctggcgacgacgaagaagcggcccgggccaagtatgcggcggtccacccggacgagcatgtgctcgcctcggtgcgtctgttcgttcgcgtgctctatgtcgagacgtcggccggctggcgccgtgaattcgatgacagtgacgcgcgcgaggtcgcgtcggcatttggtgccgcgcacgagcgcatcgtcagtaaggcgctcgagctcggcaacatgaaagcggacgcggaggacgatgcaaaaagcctccgccgaaaccccgatctccgacttgaactgacgctggcgctgcggctcggcaggacgcttgccgagctgcgcgcggacatgtcgaccgcggagttcgccttgtggcaggcgttcgatgccgagtcgccgatcgccgatgatcgttacgaccttcatgccgcgatggtcgcgtcggcggtgtttcaggcgcagggtgcgaaggtgaaggtggccgacatgatgcctaactggtcgggcgaatcgcgcgaggttcaggaggtcgccgacgatcctttcttcgcaggcctaatgaggttggtaaagtaggcggataggaaatatgggaacgagtctccgcgagctgatcgtcagcgttaccgcgaatacgacccattacgatcgccgcatgcagcagcttgggtcgacggccagcggctatttcaatgcggttcgggatggggccgggccgcagatgcggctttcgcgtcgaacgcatcaagcgtgcaggtgacggtgcgcgcgatcgaggccgcgcgcggatcgctcacggcatatgctcaggctgcggccgcggcgttcggcgtgcaccagctggtcgagtatgccgacgagtggacgaacctgagcaaccgactcaagatcgtcacgcgggatcagatcgatttcgcggtcgcgcaaagcgatgtgcttcgcatcgcgcaggcaacgcggcaaccgctcgacgcgacggctgagctgtatcagcggatcgcgaacaacacgtcgcacctcggcctgtcgattaaacaggtcggcccgctggtcgaaacgatcagtaaggcggttgcgctctcgtgtgtccgccgatacggcgcggctcggtatcgtgcagctgggtcaggcgttcgcgtccggccagctgcgcgggcaggatctgaagagcgtgctggaggaactgccgggcgttgctgacgcgatcgcccgtggcatgggtaagggcacgtccgagctgaagtcgctggccgaggacggcaagctgaccgtcgagaacctgatcgacgcgctgaagaacgccgggtcgagcacggacgcactgttcggtaaggtggacatgaccgtcgggcaggcgatgacgcgcctgcaaacggaaatcgtcgcgtacgtcgggcatgcgaacgaggcggcaggtgcgagcgcgaagctggcgcagagcgtgatctacgttgccgaccacctcgacgagatcgtcacgatcagcgcgtcgctcgcggccggccggcttggggtctatttcgcgcagaccacagtggccgtcagcaagtcggccatcgcgtggaacgccgagcggcaggcgctaatcgcgaaggcacatgcggaaaacgcggctgcgctggtcacaatcacgaaggcgcagagcgaccgcgatgcggcagcggcgaagctgcagaacgcgcaggcggcagaagtcgccgcggcggccgagctggccggcatgcgcgcaatgcgcgaaagcctggcgatgcagtcggcgctgacggccggttcgatccagtacgcgcaggcgaagctcgccgaggcgcgtgcgatcgaggcgagcgctgtggcgcaggtcgcgaccgcgcggtcgaatctggcgagcagccaggagatcggcacgcggatcgctggcacgccgtacgcggcggtgatcgcgcgcgagacggcggcggcgcagggcgagctggagcgggccgaggcatccctcgcgctggcacagcagcgccgtgtggcgctggaggctgcggcggccaagggaacggtcgaccagacgcgctacgcggcggcactggccgaaaccgagaaggggctcgcggtcgccgaacgcgaggtcgcggcggcgacgattgcccgcgagcgggccgagcgcgggcgacggccgcgactgcaggcctggccgccgcgaccgagcgcgcggcggtggcgcagactgcggccgcgcgagccggctcgttgatgcgcacggtaggttccggattgctgtcggtgatgggtggcttgcccggcatcatcgcgacggttggcacggtggcgctcggcgccgcggtgaactggctggtattccgcgatcacgcgagcagtgcgacgtcgagcctgctcgacatgcaggcgccgctcgaccagatcatcgagaagtatcggcagttgtcgccgttgctgcaggaggtcgagcgcaatcgcgcgaagcaggcgcagaccgcggcacgcagcgatgtagcggacgcatacgcgggccttgcggcgcgcgcgtcgcagagcgtcatcgtgccgggcattggagacagcgcgccgatcatcacggacgagaatcaggtcgcgcttgatcggttcattgaagggctgaaccggatcaagactgagaacctcggcgtcgacgagaagtcgcgcgagcttgcgtcgctggtcggcgtgtttatcgatgcgacgaagggcggtgacgagcttcgcgccgagctggtgcaggccgcgtcggcgatcgacacggccggcgccgcggcggacaagggcacgcgcacgctggccgcgatggatgctgccgcgcgcggtgcggccgacggcatccgactgctcaccgaagaaaacaatttcttcgcgggcggcatggcggccgaggcctggaacaagtacgtcgagaagctgaaagaggcctccgacgtcatcggcatgaccgcgcagcagcgcgccgaatacgaagcgaaaacgaagggcgcgaacacagcggaggcgcggcaggccggtttgatcgccggccgcgcggacgcgtacaaatcgctcgaaaaggcgatccaggacaaagacgcgaaggccgaggccggcgcgcggcggaacatcgacaatctgacgcgcgagctcgcgctgatgaatcagcagatggtcgttgcggcggcactggctgagtttcaggcggatctcgtcagcaagaaattcgagaaattcgggttcaacgctgacgcggcgctcgcggccgctgcggcgcgcggcaaaaggctttcgacgatacggtgtcggaatcgaccggccaggtcgcgcgcatcggcgtgaacgcgggggcgctcgcgcacaagagccgagccagcggctcgcgcgccgagccggaaagccagcgcatgctcgacaacatcgcgcagcgcattgcgcagctgcgcgtcgaagcggtcgcaaccgacaagctcacgcagtcggagaaggatcggatcgggttcgaccagaagctgaccgatctggccgcgaagcgcacgaagctgaccgacggcgacaagagcttgattcgtgatcaggctgcaattcgcgcggcgtacgaccgcgcggtgcagctggagaaggaggtgcgctatcacgaagcgatcaacaagctgaaggagcgcagcgcgcaaatcgatgcggagctggccgactacgcgtcggagcgtcaacgcgaggtcgagcgcgagctcgcagcgatgccgatgggcgacaacgcgcgcgagctgaaccaggcgacgagccgcgtcggcgatgaattccggcgccggcgcgacgatttcacgaagggcgctcggaaggacggcacgctcgggtcgccggagtatctggccgagattgaccggattaaccgggctgaagccgaacaggtcgagcgcgaacgtgggtatgtcgagcagcggctcgcggtgcagcgcgactggcgcgtcggtgcaagccgcgcagtggcgctgtatcaggaatcggcggataacgcggctggtcgatccgaggaagcgttcacgagtgcgttcagaaacatggaggacgcggccgcgtcgttcgcgacgtcgggcaaggtgaatttccgaggactcgtcgacagcatgatcgcggatcttgcgcgcttttatacgcgagcgggattgtccgctgttatcggttgggaagctcggcgctcggcctcgatacgggaggctcgggcggattcagctcgtcgtcgttgctcggcggtgtgatgggcggtctgtccaatgcttttggggcgggcggcggcaacgcgtatcaatttcacctcgctggcggtgggcgggtaagtgggccgggtacgtcgacgagcgacagcattccagcatggctttctgaccaggagtttgtggtgaaggctgcggcggtgcgcaaacccggggtgcttcggctgctggaggcgatcaacagcggacaggatctcggtttcgcgaagtttgcaaatggcggactggtcggcggcggatcggccggcgggggcggcctcggcgcgcagggcggagggatcgagctgaatatcccagtgacgattgacggtggcacgggcaacgcggcgcagatgatggcgagcgccgagttcgtgaagaagctcacgcaaatggtgcaggggctgatcgcggtcgaaagtcgtcagggtggcgcgctctggaaactgaaaaatgggatggggtgatgaccgacacgtttaactggtcgccgacggttgagggtttcggcggcgacacaacgctgcgcgtgcgaaaggcgcccttcggcgatgggtacacgcagcgcgcggccgatggcctcaacaaccgcgtgccgtcgtacaaccttcgattcgtggggaaggccgacaagatctcggcaatcctagcgttcctcgatgcgcatgccggcgcggtgtcgttttctggacaccgccgcttcggccgcaggcgcggttcgtgtgtgagaagtacaccgagccggtgagaagcgggcgcgtgtacacgatcacagcgcagtttgagcagacgtttgcaccgtaggacatgacatggcagaacttcaaaggcaaacctgggtgcgccgcctggtggtgatggcggcgatacccaacgtgtcgcgaacactaaattcaacgcgaacgttgacatcctgagaactcaggcggcgctggcgtcagcgggagccagcattacggtgccgcgcacgctgacggttgacgagcatgtcggtcgacgtgttggaatcaacctagcgaacgcaggaacgatcaaagtgccgtcggcgaagaagtgcgctgctgaccaggtgattttcctgcgcaacttcggaaccaccgtggtgacgctcgcggtcgaggacggatcgggcgactacattggacttgaccgacttcagccattcgaaaccgtcttgatggacacgaacggctctaccggttggtgggttttgtatcgcggcagggcgagttcaggaaatgagtcggtcgtgggtaatcttgcggtcggcggttctctgtctgtcgccgggccattgtctgtcccggaggtattgcgggtgacgtttcagcgagcgggagaatcagcgggtcaacagtccaaaccttctagttaatggctcggggagcttggaaatactggctgggttggcgctaccttcggggtcgtgcagggagctacggggaggggtcgctgttcggcaacgctaacgcgatcaatacggggacgtgggtagttgatgcatccattgacatcccgtgcgccccggcgttccgctcacgttgtcggcagaaatttattcgatgggactcaacgctggaagcgtatatgtgaaatgcgatgcgtttaagtctgatggaaccttcatcgggtctgttgctgcgacggctcccatcacgaccaagcagggctacgtgttccgtagtagcacggccgtgacgcccggtggcacggcgtttgtgcgcgtgaacagggcggctgataacgccccgaacatttcggcattcggcgttgcgtttcgcagaatcaagttggagagaaacaacggggcgacgctctattcccaagaggcgagtattgcctacctgggcggtgcgccagcatttgcggggcgcccgacctttgctggaagggcccttgggattctggaaaccttgcgaatccgatggatctcgacgggacccagaccgttaccggcctgaagagcttcacgcagcgtatctccgtcacgaaagacccagtgaatggtgcatatgcgaacgctcccgtctgcttggtggcgccgactggtatggcatcgtttgcccttgcgagcaagaacggagcgtccgtggtgcagttgcgttgcacttccgacactagcacgcttgaggtggtcaacggatcctccggtgcataccagccgatcacctgttattcggtgacgcaaacctcggatgcgcgcctgaaatcggacgttcagacgattaccggcgcgctggaaaagctgcgcaagcttcggggcgtctattacgtgatgaatgaggttcgcggcgtcggcgtcattgcccaggaggtaggcgaggtctttccggaggtagtggaggaactcggggtatctgccgaggatggcacgccatatctggggtcaactacgcgaacatggttgggcctctcctgcaaggaatgcttgagatcgatgaagcattgcaggaggcgatgaagcgtatcacggcgttggagccggaaaaatgagcatcactgccgatattcagaagctggagccggggcatcgcatcgagctgttagaagtcaactgcacggaaatcggcggagacgtgctgctctttcacggacacctgcagtcgacgtcgatcgtgtggcagggtcggaaatataagccctggcctatccaggcggctggcttcgagcggacatcggacgctcggcagccggcgccgaaactgacggtaggcgacatcaacggcacgatcaccgcactgtgcgtcgcgctcggtgatcttgtcggcgcgaaggtgttccgccgacgcacgctggcgaagtacctcgacgcggtgaattttgccgacggcaacccgactgcggacccgaatgagcaatggccggtcgagcagtggcgtatcgagcagaaaagcgacgagcaaccgggcgtgcaggtcgagttcacgttgtcgtcgccgctcgacttcggcgggcaacaggtgccggcgcgccagattgttggcacgtgccagtggcgctatcgcggacccgaatgtggatatgtcggcatggtgtacttcgacaagtacgacaagccggtgagcgatccagcgctcgatcgctgtagccagaaagttagcggatgcgaatgccggtacggcgtgaacaacccgctgccgtacggcggcttcttgtgcgacaccctcgcctagaccgtcgaccaacctctcttcatggacccgccacccggcgggtttttatggacgaacgaatcaagcaggcgatcgcggagcacgcgctcgccgagtacccgcgcgagtgctgtgggctcgtcgtcggcacggcggccggcgacgtgtacgtgcccggccgcaacatcgcggccgtgcccaccgagcaattcgggctcgcggcggaggattacgcggatgcggaggacatgggcgaaatcctcgcgttcgtgcactcacatccgaacggacgggcacagccgagcatggcggaccgcacagtatgcgagcgttccggcatcccgctgtgggcgatcgtctcgctcggtgtgcaggccgacggcacgatcggtgtcgacgactggtgcgagttcggcccgagcggatacgttgcgccgctctatggccgggaattcctgcacggcgtgctggactgctattcgctggtgcgcgattggtacctcgccgagcgtggcgtcgtactgccggatttcgaacgtgaagatggctggtgggacgacggtcgctccaatctgtatgtcgcgcactaccaggatgccggctttctcgacgtcgggatcgacgtacagctcgagccgggtgacgtgctgctgatgcagatccgaagcaagaacggcgtgccgaatcacgcgggcgtgtatctcggcgacggcatgttcgggcatcacgtgcacgggcgactgtcgtgccgcgcggtgtggggctcgatgtggcgcgacagctgtacgacggtgttgaggcacatcggggagcgaagtgatggaaaagctgcgcgaggtgaggctttacgggatcgcgggcgcgcggtttggtcgggtgcaccgcgtggccgtctcgtcgaccgcggaggccgtgcgcgcgctttcggtgctgatcccgggtttccagaagttcctgctcgacgcgcgcgacaacgggttgacgtttgcggtgttcaacggccgccgaaacctgagcgaaggcgatctgggtgcgccggttggcggcgaagcgatccggattgcgccggtgatcatcggcagcaagagcggtggtctgttccagacgattctcggtgcggcgttggccgtggctggtttcgtgttcagtcagccgacgctgatcggcctgggcgtgtcgatggcactcggcggcatcacgcagatgctgagtccgcaacaggctgggctcgctggcgtcgcggacaacggcacgtcgtactacttcaacggaccggtgaatggcgctgctgaaggcgagccggtgtcgctcgatcggagagatggtcgtcggatcgaaggtggccagttcgggcatctacacagaggatcaggtgtgaaaaagatctacgcggaatcgggtttgaagcgaatcaacggtgcgaaaggcggcggcggtggtgggagtggcggcggcgaatcgccggacagcctgcactcgattgcacgtgcgaaggtgctcgacataatttccgaagggccgatcgtcggcttggtgaagggcatgcagtcggtattcctcgacggcacgccgatcctgaattccgacggatcggtcaacttccagaattacagcgtcgacgttcgcacgggcacgctcgaccaggatttcatgccgggctttccggcggtcgagcgcgaatcggccgtaggcgtgccgctgacttccgatgcaccgtgggtgcgccaggtgcaaaacacgcagctatcggcagtccgtattcgcttcggcgtgccggcgttgcaaaagagcgatccggcgaccggcgtgtttggctatcgcgtggaatatgcgatcgacctgtcggtcgacgggggctcgtacgcacaggtgctggcgtcggcattcgatggcaaaacaacgtcgctttacgagcgctcacaccggatcgagttgcctcgtgcgacaagcggctggttgctccgcgtgcgtcgcatcacgccgaacgcgcacagctcgctgatcgcggacacggtgaacatcgaggcgatcacagaggtgatcgatcgcaagctgcggtatccgatgacggcgctcgttggcatgacgttcgacgcgcggtcgttctcgcaggtgccagtgcggtcgtaccacattcgcggcctgatcgttcgggtgccgtcgaactacgatcccgagacgcgcgcgtactcggggcatgggacgggacgttcaagccggcgtggacgaacaacccagcgtggattttctacgacctgctgctgaacgatcgctacgggcttggcaagacggtcgacgcgtcgatgatcgataagtgggggctgtacgagatcgcgcgctattgcgacgtcatggtgtcggatgggcggggcggcgtcgagccgcgcttcacgtgcaattgcgcgatccagtcggcggccgacgcgtacaaggtactgcaggatattgccagcgtgttccgcggcatttcgtactgggggccgggcgcggtggtcgcgtctgcggacatgccgtccgatccggtctacgtgtacaccgcggcgaacgtgatcgacggtgcgttccggtacgtgggtagtgagcgaaagacgcgatacacggtcgcgcttgtcagctacaacgatccgtcgaaccagtacaagcaggcggtcgagtatgtgccggacgacgacggcatcgcgcggtacggcgtcatcaagacgcaggtaacggcgttcggttgcacgtcacaggcgcaagcgcatcggctcggtcggtggcttctcctgacgtctcgctacgagtcgggcacggtgtcgttcaaggtcgggatggatggcgtgctggtcggcccggggcaggtgatcgcgatcgccgatccgcgaaaggctggccgacgcatcggcgggcgcattcgagcggcggccggcaacgtcgtcacgctcgacaaggcgccgaccgtggcgcccggcgatcgctttacggcgattctgccgtcgggtgtcgcgcagtaccgtgcggtgaagtccgtcaatggcgacgtgcttacgctggccgatcgcttcgacgcggatccggtgcccggtgcggtgtggatgctggaaaacgcggaggttgcggcgcagctctatcgcgtcgtgagcgttcaggaaggcgacgacgacgggcgcattgagtacacgatcacggcgacgatgcacgagccgggcaagtacgcggcgatcgacgacggcgcgcagattcagcagcggccggtgacggtcgtaccgccgtcggtgcaggcgccgccggccaacgtgcggattaccacgtattcggcggtcgaccagggcatttcgaaaacgacgatggtcatcgcgtgggatgccgcgaataacgccgtgacatacctgccggagtggcggaaggataacggcgagtgggtgagcgtgccgcgtacgggcggcctgcaagtcgaggtgcccgggatttaccaggggcggtacgttgcgcgcgtgcgtgcacaaaacgtgatgaacgtcacgtcgcttccggccatcagcgcggaaacgcaactgaagggaaaacgaacctcccgccggcggtcgtgtctctcaaagtggcgggtgtggtctacggcatcaacctcgactgggcgtttcccggcgatggttctgccggcgacacacagcgcacggaactctggtacagccgcacgccgaaccgtgcggacgcgatcaagctgtcggattacgcgttcccgcaagcttcgacgtccatgcaggggctcgcggtcggccaggtgttctatttctgggcacggctcgtcgacacgactgggaatatcggcccgtggtttccggcaaatggttcagttgtgcagggtcagccgtcgacggacgaaggcgagtacgagaaatattttgctggccagatctcgcgctcggcgctcagtgaggatctaaaaacccatcgacgcgattcccggattcagcagggcgttacagataacgcggcggcgatcgcaaaggaggtgaaggatcgcaccgatgcgatcacgaaagaggcgaaggatcgagccgatgcggtagccgaagaagcgcgccagcgtggtgcggctgtcgcgtccgagcagcaggcgcggcagtcggccgatagttcgctcgggcagcggatcgataccgtgacggcgagcgtcggagacgcggcggccgcagtgaagcgagaggaagccgcgcgtatcgatgcagacggtgcgcttggcaagcgcgtcgacacagttgtcgtgaaggttggcgaagcaacgacgtcgattcaatcggaagtacaagcgcgtcaggatggcgacggcgcgctcgggaagcgaatcgacgctgtaagtgtcgctgttggggagaacaaggcggacattatcaccgagcagcaggttcgccaaaaggcggactccgcactggccagccgcattgactccgtgtcggcacagatcaatgttccgatggcaggtgacagcggccaggcggccggatcgacgcaggtaatggctggcgtttattcggagcaatcggcgcgtgccgaggccgacatggcggcggggcaacggctcgacactgtttacgcgcagatgcaggttgggcaggcggcgttgcttgcggacattcgtacggaatcgaaagcgcgtgtggatgcgatcagcgcgcaggccgagcagatcacgacgatacgcgcgcaggccaacgagaacgccgcggcagtccagacggtcgcgcagtcatacgcggatctgaatgggcgcgtttcggcgtcgtaccagatcaagacgcagatcacgtcggacggtcgcacgtacatcgccggtatcgggatcggcatcaacaacgacagcggcattgtcgagtcgcaggtgttggtgtcggcccagcgcttcgcggtggttgacccgaacaacggcggatcgtcgatcgtgcctttcgtggtgcagggtgggcaggtgttcttgcgtcaggcgctcatcggtgccggctggatcacgaacgcgatgatcggcagctatatccagtccgacaattatgtcgcgggaaagcagggctggcggctcgataagagcggctggtttgagatcaactcgactgatggtctcggcaaccggacggtgatcgatagtaatggcgggcgcgtgtacgacgcaaacggcgtcatgcgtgttcgatgggggtatggagggtataggggtaatggacgcggggttctgggtttgggatggtgcggggcgcttggtgctcgacggtacgtcgcgggccgggcggatcgttgggatcgtgtacacgggaggcggcgctgggtccaatccggttgacttgtccggggcacgccgttctgggcgttcatgccgcagtggatttttcgccgtgtcggcggtgcagagcctacgccgcttgtcgcgatcgacgcatttggaatcagttggtcgtacagcggcaatagcagcggttcgaatgcttactcgcctgtgcctggctggcttgttttcggggtgtattgatggatgcaggatttcaagcatttacgaatagcggcctttaccaaattgatggaaggacaccgaactatcagctcgtgagatcgatgtcagggcaggcggtagacacgtcgttaccgctcgcggtcaacgatgcgggaagccgttcggggcgacggttccaagcatcgcattttcgttcaacgcgacggctgggccgatgtatggcgtgtatgcatctgacggcgttgggatctcggtttggagcgtgagtgtcgatggtggcgtgtacacgattcgtttcgtaacggagcgcccgtgcgctgtctacttcttttgttcgatcgcacgcctcctgcgactagtggcttcgggcttcaagtatttgcgccagatacgaagctcatcgcggacacgtcggtgcctttccttcgtgtgctcgatgtgattaccgaccactacgtgccaggcacggggtttgtgacgatcggcgcgccttggccgccgtggcagtcgcggtcgtacggccggccggtgttgatttcggctattgcacctgtgcatgtcggttggagttatgacccagccggcctggagatgacgtcgattcgtgtgacgggcgacacgattgcatggggaacatcgatgtggggaggcgggaagaagccaaactttacgggatttaaagagcagtggcatcacatgttcatggtgctagatgcgacggggattttgatgggccgccaattttgagcggcccttttctttacggggaacagatgcgagcgagtccaaccgaggtggcgagctacgtggggagcgttactgctgtggcgtcgtcgctgacgctgaccgacatcggggtgatcgtcggtattttgacggcgttcgcgacgttcgcactcaatttcttttatgtggcggaaagatcgccgggaacagcgcgagtcggatatgcgcatcatggagatggagaggcacgatggctgatttgccgaagaagacgcttgttggtgttgtggggctgctgcggcagcccttctttccgcagtgccgaagttcgagggcgaggtgttggtcgctgcgccggaccctatcgggatcgttaccggatgcttcggcgatacgaaggacgtgaagcttggccagcgcttcacgcacgacgaatgtatcgctcggctcgagcagcgtcttatcgagcatgcggagccgacgctgaaatgcacgcccggtctgaaagggcatccgtatcagctcgcagcgggcgtgagctttgcctataacgtcggtgcaggcgcctactgccgcagcacgacggcaaagcggttcaacgcgggagactggaaggggcatgccgcgcgatgaatgagtcggacagtggcaagccgcagtgggtatatggcggtggccgcgtgctgccggggctggtgaaacggcgcgcgtttgagcgctcgttatgcgaacgggggctgtgatggtgaaagccttattgccgtatctgctgactattctggccggcttctcggccggcgcctatgtcgttcacgcgaccagttctcgcgagattgcgggcatgcgcgccgatgccgctaaggatcgggcgatggccgtcgaggccgcccgcaatgaggaacaacgccgcgctgcggcgcaatcggagatagcaaagatgcgaacaaacaaagaacggacgcgcttgcggatgcttttgctgctcgtgctgccgctggcagcttgcagcagcgcgtcgatcagctcgtcgcagccgcccgccattccgccgctgccaccggaagcccggcagccggcgacgccctcgatctgcttgccgacgtgctcggccgcgctgaccagcgcgcgggcgatctggcagagtacgctgaccgagcccgcatcgccggccagcattgtgaacgcgactacgacgccctgacggcagccgcgcgctgaaaccttccacatttgacgggcacgcagccatggctcctgcgcgtcacatcatcccagcgcgccccttttcattccggagaaggtggcgcagctcctgaaactgcccattcccaccgctcagctccccgcggtcggggatgttcttgtcgacgtagtcgaaccactcttggatcctgtccagcgattttcgaagagcaagaatctcgaggattagccagcgcacctgaaggtcggtgtactcgcgccagagggctcgcagctccgcatcggacggggcatcaaattccggcatcttaggcttcaacttgaagcgtggatccgtgagcggcacgcggttgcgatcaatcctcgttgcttcgatcggcgtgcacgaactcaggaacgtcgacctctcgtcctgatcaatccacagttcaaattcctgcttcgtgagctcgataggcgtcctccggcgcatcttgtcgccttggaatccgtactcccagatgtaagcccactgcggcttgatcacgtcgccaccactgtataaaaacacagtgtatcccggggtaagatggggccgtcaagagcgaaaataggggacggctgatgtgcaccagctactacgcgccgggcgaggatccgggtctcagcgagctcaaaatcgacaacttccacgacctgtaccgctggacgccgtggaagcccgagatctaccaggactacgacgcgccgatcgtgggcaatgtcgacggacagttcaaggccctgatcgctgctttcggcttctggccgcgcgcgcttcagaaggccaatatcgagaaggcgaaggagcagggccggaagcctccgttcattcgcagcacgatgaacgtgcgcgacgataacctcgggaagtcgccgctgtacgggcccgcctggcgcgccggccggcgttgcttgattccagcccgatccgtcatcgaaccgtcttatcctgacgtgagccaggaagcgaatggcgactgggtgctcgggccgtgcgtatggcagaaaattggcgtggtcggccggccgacgatgtgcgtcgccggcatctggcgcacgctgacgaatcaggacggctccgagcatcacgtgatgtcgatgattaccgtcaacgccgacagccacccgctgatgtcgcgcatgcacaaaccggcagatgagaagcggtcggtcgtgatcctgcggcccgacgactgggaggaatggctcacgacatcgaatattgaggccgcgcgcgcgatgctgcagctctatccggccgacgagatgtacgccgaggcgaagtaattcggcgttacgccaaatttacgccaaatttgccagcgaggcttgctgtataaggcttggatggggtatcgctggtcccccgacagggatcgcatttgcatttagagcgtgaatggcccgttttgggctaagcgtcgttgatatgcaagttccttcgcggtgacatcgtcgatcatgtcttgcagcagttgatctcgactaggcgcattcggcggcggctcgagagagtcaaggtttgcgagcgcgcgcaattggcgtgcgagagctccagctcgtaagccgagcgttgcgtagtcacgccttcgtgcccaaaaatattcagcatgagccggcgggtcatagttgaattctatgatgcctcccagtcgattttgtatttggtcacgctcgtcgggtaagcgcaggatcgcgtgcatgatttcgcgcggcagcgctttccactcgactttgatttctaggggcagaaattctggcgcgcgggttgttggtttgtgctccccgttcttgcctgcggggtgcccttctgaggtgccgtcgtcgagcgcaacgcttaggcaaccattggcaaatcggtcgaggtgtgacgcgacgacaatagcaaggtacgcggcatccgcatcgcgtcgggtcttactcacccaccactccttaactgctacaaagagattacctagtatcaccccggtgatacccgcagaggccgagatgatcgcagagatgttgccgttgtccataggtgtcatttggatgcggttagcctgccggcgggcgctctggcgtgcacgaaatggagctattatgtccgtccccgcggttgacggaaaggcagcagccgtcgcgagcgcttcgggaagtgcgcgagcctgagttttccgagggtttaagaggaagcaaagaatggagacaatccatcatgtgatccacttcgtcggaaggtttgccgaggtgactacagcgatttgcgtgattgcggacctagttctaaaattcatgcgatgagcgaaagcccgctatggcgggctttttctgcccagcggctattgctaagaatcaagaatctcctttaattcggcgataaagagggtggtatccccgaaatagttcggatatgctattttcaaagcatgaacggaatcggccattaccaagacggcatcgacgccaactcgattttcttcttctattttcttgtaatcagaagctgcttcttcgaattgattttgtgagtatgaggtaacaaaaacctcttgaaaggcgatatcgagtttcattaggaagtacgctgacttccgccgagctggatctgcgataacttccttcatcattgcttgaaaggctgtcagccgctccacaacgtgcagttcggcttcaaatgcaataagtctgttacgaatggtggcaaaatcttcgtcgcctgggacaccttcgcggtgcgcgaacgctacggaaatcaaagcgaagtactcaagccatgcttgctcgccctgatcggcttttagtttttgattggtcaaagagccaactgtctcaaccgcggtcgcccatgcgtgctgcctctttgttctaatctgaatctcgatcgaatggttgttatatgtttctttttatcgctggcgtagcgatataccaaatgaatgccgcgatacccgtcatccttcggagcgaggatgtagtcctttcgtttaccagtcgatgtttaattcggcttgttttgatggaatcttgcaattgatgcacttgttctagcgatgagagcacggctcgacatccaccgatgtcttgcatctgagtaaggcgcattctcgggaagcgctttaatttgtcgataattgatgtcgcacgcttcagccgctgtgcgacaaatgcgccgtcatcgatctttatggctcggtcacgcaaattgattttgaatgtatttagagggaactggtgagaggcgcgccaatttgacatgatcaccattgcttctatgtattcgtcgataccgcgcaaatcgataacgtcgccgcctctatccggaatgatgccgtcgacaagactgcggcccgcagcatttacgcgttcacgcgaatattcgggctcaatccaatccatggtccacctcgtagaatgtgtgcggcgtgctgtgctgagacgacggcttcacttcttacctgtaagattctgccatgacaattcgagggccgtctgaaaaaggggcatgaaatatctggcgtaggttttggcgtaacttttgagtcgggcccagatgtggtaatgaatcctattacttcgaagaaaacgagtaatccccgcgggcgcccggtgcccgtttctcgtcatctgttcccgtgatcgtcgccggcggacgcgacgatcacgatttcccttcgtcctctctgccttcgggttggtgacgacactcgcgtcacgccgcctgaacgatcctgttccccatgtccacaccgtcgaaaatcgaaaccgcgcgtctgacgctgcgtcgctggcggccggtggatgcgggcgcgctgtcggcgctgcatgcggatccggacgtgactgcgtggctcgcgcgcggcccgatgtccgttgacgaggcgagcgacgtcatcgcgcgcttcgactcgcatttcgatgcgtacggcttcggcccgtgggcggtcgagcgccgcgccgacgggatgttgatcggggtgtgcggcctgtcgcacgaggtgcgcgcaacgcacccgatggcgccgtgcgtcgagatcatgtggcggcaggctcgccacgcatggggacatggctacgtcgccgaagcggccgccgccgcgttggccgacgggttcgagcggatcgggctcggcgagatcctcgcgtggaccgccgacactaatctacgatcgcagcacgtgatgcagcggctcggcatgcaccatcagcccgcgcgcgatttcgaccatcctgcgttgccggaagggcacgcgctgcgtcggcacgtcgtgtatgccgcccgcgccgccggcctggccggcgcgtaacgactcacgcggattcgctcgtcagcgccacgtaccgttctgcagcacgatccggtagccgtcggcatcctcgaaggtctggccggatatttcccagtacggattgaacgacgtcacgggcatgaagccgtgtgccgtggcgcgcgcgcaggcggcttcccattccggccgatcgggcaggtagaacacgatcaggtcttccggcgtcggcgacggcgcgatcggatggtcggggcagtgcgtgaattcgaagtgatagtcgaggccgtcgcgtccgagcatcacgccggaaaagccgtcgtgatcctcaaagcgtgcgagaacggacaggtcgagagcgtcgcgatacatgcgctcggttcgggcgaggttgctgaccgggcgggcaatgcgcagatgggcgtgcaagatggcctcggggagcgtggcagacccgccgatgataatcgatccggattgcggcgcgtcggaatacccgggcaagcaatcgatgaaggagggcggtggtatggccccgcaattcgagcaggcaagaaaaagcccgctacattgagcgggctgaatccatgtttggagacatggaggagacagacgtgaatttaagggaaaacccgaggcatggcaagccctagttgtatcgatacaacttcctgttgtgccgcgttcacataccgctggcccgcgcatgcgccgcaaacgcgctgaaccgctcctgcgcgaccggcagcgcgaacttgtcgcgcatctccgtctcgatccatgcacaggcctcgcgtgcgcagtcggtcagcgcgtggcgtgtcgcatgcccgtcgatgtcatagacgaagcgcacgccgacctcgtcgtcggcgacctgtcgctcgagctggttgagctgcagttgcggcccgtgctgctgcgaaagcgcacgcaattcgtcgaagtgatattcgagccagtcggcaaagaacagcgcgtcgctgtggcacggcagtcggaaggccgcgctgcgcgacggacgcggcccggcttcaccggccggtgcgtgcgattcgccgtcggtggccatggacatgtcgacaggggcgagcggatgctgaagccggcggtagggctcgcgatcgcgcagcgcatgccacagcaattcgtcaccggcggcgccggacggctgcatcgtcaggtcatgccggccttcgccggccggggcgatgtcgcggatcacgaggcgcagcgagcagagcggttcgtccgcgaccagcaacgtcgccgcacgcggcagcccgcagaccagcggcgccgcgccggcggcacggaacacgaggccgcgccggtcgagccgcacgagcggcagcggccgtggaaacgacgggtaggcgaccgcgatgcgggcgccgccggcgctcgtcaacccgggcatcatcgcgcgaaagacctgagactggtccacgttgattctccttcgttacgatgccgcccggacaggaacgcgcgttccgggtcaggcggcgatggcttgccgggcggcctgccccggctcgattcctagcgcggcaaacgtttgcggatcgatgtcgatccagcacgcgaccaccagacgcccatctacctgcttcggcgggcctgcgcggtgcgcgtgtatgccgatccggcggaacaaccgctccatgctcgcgaacgtcacgccgatcaactgccgcgcgccgagctgcgccgcgcactcgacgacggccgcgagcatcgggcgcacggcccattcggcgttgcccggcccgccttcgtcgtcggtcgccgcgaaccgggacagctcccagacagcggccgattgcggcagcggcatgtcttcggcgatcaggtcggcgaacagcgacttcagcagatacgggcgcgtcgtcggcagcaggcgcgcacatccgcacatgtcgccgccagcgtttcgcgcgaacacgtagacggtatcgtcgcgatcgaactggtcgcgctcgaagctttcgttcgccgacgggagcgcccaaccgagctgttcgacgaacacacggcgccgatagcgcccgagatccgctgcaagttcgtgtggcaaccgcccttcctcgtgaacgaaggtccgcatggtgtcctcggatttgtgcttttgtatgtgcgcattacatcgcgccgcacgagggctgtaactggtaactcttacagggtgacggtggaatgacgccgatcaggacgtggtaacggtttcttgatcaacgggattgaaaaccgggccgcttttgcttataaagagcgccagcactgcggaaattgtcagaggaatgcggggccagttgtcactggagcgtcggaccggcatgataggcgtcgttgtgcccgagcagggccgacgcgaccgctgcgggccagtcgatgcacgcgagccgcgcggcaagcgcggcggccgtgcggaacatgccgatgtcggcacccgtggcgtcgacggccatcacgttgctgcggacgtcgccgcccgcgatcacgaacgtgcccgtcgcgcgttcgaggtaccagtcccagccgaccgtcacgtaagcgacgccggcactggccgggcgatgccattcggtataaccggcgaggcgtgcgtcgattgcgctgtcgcgcagttccgcacgcagcgatgcgtcgaggccgcttgcgacatggtcgagcgcgagcacggccagtgcgctttctgacaggcgtacgtagccgtccggggacgggccggggaccgggtgcagcaaaggtgaagtcatgcgcggaatgtatcagcgtcgaacgggtgctggaacctgacaagtatgacagcgtgacgttgtcggagaatgaatggaactgcgctggcaggatgcctatcaacaattcagtgccgcggaagacgagcagcagctcttccagcggattgccgcctattccaaacggctgggattcgaatactgctgttatggcattcgcgtgccgctgccggtatcgaagccgtcggtagccatcttcgatacctatcccgacggctggatggcgcactatcaggcgcacaactacatcgagatcgattcgacggttcgtgacggcgcgctcagcaccaacatgatcgtctggccggacgtcgaccagatcgaaccgtgcccgctgtggcaggacgcgcgggatttcgggctgtcggtgggcgtcgcgcaatcgagctgggcggcccgcggcgcgttcggcctgctgagcatcgcacgccatgcggaccgcctgacgccggccgaaatcaacatgctgacgctgcagacgaactggctcgcgaacctgtcgcattcgctgatgagccgcttcatggtgccgaagctgtcgccggcggcgggcgtcacgctgaccgcgcgcgagcgcgaggtgctgtgctggacggccgagggcaagaccgcgtgcgaaatcggccagatcctcagcatctcggagcgaacggtcaacttccatgtcaacaacatcctcgagaagctgggtgcgacgaacaaggtccaggcggtcgtcaaggcaatctcggccgggctgatcgaggcgccctgacctcgaacgagggcgggcggcagcgcgaatgccgctgccgccaggccgctcactccatcatcggctccgcttccttcgcggtccagctcacgctggaaatgctcttctccatgctcatccggctcgcgatctgctcgagcttctgctgatccttcggatgcagcttcagtgttgcggtcaccttcagccggtccggctggtcgggcacgtcctcgctcgtgaggctttggaacgacagcggcttcgcatacatcgagttcgacagcagcgtgcggatgtgcacttcgtcggcggtcaggcagatcacggtgatctggtattcgcgcacgagatcggcgttcgacaccggggttgcgttgatcgcctggctgacgccgcgcagcaccgtattggtgaggagtacgacgcccgtgccggcaagcgcgggcacgtaatgaccggagccggccagtacgccgacggcggccgagcaccacagggtcgcggccgtgttgatgccctggatcgagcccttgtcgcgcatgatcacgccgccgccgagaaagccgacgcccgacacgacgtatgcggcgatctgcgtgacgcccgcgacgccgttgccggtcagcacgccgagcgtgacgaacaggcacgcgccgctcgcgacgagcgtgatcgtgcgcaggccggccgtgcgctggcgcatctggcgctcgaggccgatggcgacgccgcaagcgaacgcggtgaaaaggcggagtgcgaaatcgaaagtcatggttgtcctgccgtgcaaggagcgcgtgccgtcccgcgtcgctgcggcgcaaggccgaatgcgacacgacgatagccgtcatcgcgcggtactgtaccgcgcgaatgcgtcattcagtgtgaaacggtgggcgtgcggctcgcggaacgcgagccgggcaggagaactgcgtcggacaggcgttcaggcggcaagcggcgcacgcaacggagtgctgcaactgtccacgatggttcctgaaggaagaatgggcggcattctagtgggcggcgcgcgcatgcgtcaaccgcctcgcggcggtcgtgctactgcgccgagccgatcgtccccgtcgcgagcgcgagcgcggcggcagcggacagcgcaccggcatagctgtcgacctccgcgttgcgcgcggcgagcaactggctttgcgcgatcgtcgcatcggtgaccgaaccgacgccgttccggtacgcggtcagcgccgcgtcgtagctcgtctgcgcggcatcgacgagcgccttcgcggcgtcgtgcgacgcaaggctcgtctgcaccgcgttctgcgcggcgaccacctggcggacagcttcctccttggtccgcgtgagtcgcgcggacgcgctttccgcgtcgttgcgcgcctgcatcagcacggccgagcgcatgccgccgtcgtacagcgggatcgtcacgccgaggaacacgccgccgccgtagcggctgccgttcaggttgacggtcggtgactggtcgccgatcgcgggcagcgcggagatggacgtgccgccgctcgcgtacgacgtcgacgcagacaggaagatcttcggcatgaacgcggcttccgcggccttgatcttcgcgcgattggctttttcaagcgcgaacgcgccctgcaggtcggggcggcgcgcaattgcgtccgacacgatcgcgtcgaccgacgagccgagtgcgggcggcagcggccgcttcggcagcgcggcgatggtcggcttcgacagcggcgagatgccgagcgcggagacgagggcgaggtagctgtcgctctccgcgccgttcgcctgcacgagcgcgaggtttgcctgcgcgcggttctgcgtcgcctgcgcgagctcgacgaccgtgccgacgccgtgcttgagccgcgcgcggaggccgcgaggatcgcgtccgcgttcgcgaggccctgctgcgcgctgagggcgcgcgagcgcgcggcttcgtagcggtagtacgcgacggtcacgtcgtggatcacctgctgatgcacagccgtgaacgcgacgttcgacgcgatcgacgcctgctcggccgcctcgacgcgcgccgcgcggccgccgaaatcgaacagcagccattgcagcgacagcgccgagatcgtgccgtgaacggtggtgtcgctcgacgagtcgccgaggatcgtcgacgtcgagccgtggttggcctggtacgcgcccatggccgtcgccgacaacctcggcaggtaggcggccttggccaggccgaccgcgagcgccgcgttgcgcgcgtcgttccaggcgatgcgggtcagcgggttcgccgactcggcgagatcgatcagttcgggcagcgtgtacgcgtgcgcggcatcgagcgcagccggcggcgagaccgacgcgagcgcgggcgacgcgggcagcgtgtagtcgtgagaaccttgcgcggacgcgcgcggcgggcccggcacgatgtcgccggcagccgacgtttgcggctgccatgggcggtcggacgcctccggcgccagatcgaccgacgacgtcgcgcagccggccagcgcgacggcggtcgcgagggcggcggcggcgatcgaggcggccggcggttcaggtaggcgcatgggggcaggctccttcggtgtggcttgacgggcggcgtcggcgatgtgcgcgagccgcgtgtcgatcaggttcagcagcgcgtcgcgcgcagggtcggcaggggcaaggcccggcgcggtggccggcggtgcgggcgaatccgcatgacgcgcggcttcgtcatcgcgcgggtcggtcacgcgcgcgagctgcgcggcgatcgccgcgtcgccgggcttgcgttcggcgagcaggaacagcgggccttcgagcgcgtcgagttccgcgagcgcgcgccgccgcgtggcgagccacgtggcggccggtcgcacccacgacggttcgtagtgaaccagcccgagcgcctgcgcgatcgcaccgtggcgggcgaacgcgtcggccgcgagcgcgcgccgctcggccggctgcgcgacctgcgcgaggcgccgccactggtccgtcagcgcggcgagcccggcgtcgatctgcttgccgatgctgacgggccagatgcgcgtgaacacgagatacacgacgacgttgccgagcaggatgccgatcgtgcggtcgcgcgcgatcgtcaggtcgaaaccggggccggcgccctggatcacgcacaggaaaaacgcgaacgcgatctggaagcccgcgtacgcgatgcgcggcgagccgaatgcgacccacgcggcgagccacccgccggcgaacaccagcgccatcagatggccgaccgacgacagcgacggcacgacgaagacgagtgccgctgtgccgagcagcgcgccgacgatgcagccgagaatccgcagcgtgagcttctcgaccgtctcggccgtcgaaccgagcgacacgatgtagcaggtgacgacgcacgtatggatgcccgaccagtcgagctgcgaatacagcagatagcagaagattgccgcggcggtcgtcttcagcgcgtagcggatgtggtcgggattggtgcgcgcgtcgggcaggaagaagccgccgcgcggtgcgggcggcgcggcggcttccgcggcggcaggcgttccggccgcggccgccggcgtgttggccgcggcggccggtgcatccgtcgcggcttcggccgctgcgaccggttccgcgaagcgcgtgatcgccgcatggatatccgtgacggcgacgcgcgagagcggcggcaatgtgtcggccggcggcagcgtgagcgtcacgtcgacggggtagccgccctggtcgaggatgtcggccatctcgtcgagcgtcgcggcgatcggggtggcgtatgtgtcgggcaggcgcgcgcccggttcgcgatcggccagcgcgacgccgacgagcagcgcggtgctcgatgccacggcctgccgcaacgccgcgaagtcggcggcggacgacgtgccttcgagcgtcgacagcttgagccacgtgagcagctgcttgtcgccttcgtgaaggctggcatcgaatgcgtcgcgcgccgcatcgtcgccgcgcagccgctgcgcggcgagccgcaggcgcttcgcgagctgtgcgtgcgcgagcttgcgcggcgacggcgcgatcagcaggttgacgacgatcgcgacaccggccgggatcgcgatcgtcagccagatgtacagcagcgcgcgcgtcgcggcttcgccgaacggcgcgaggccgagctggtcgagcccgaagccgacgatcatcgcgaggatcgcgcccaccgggcgcagcttgctggcggaagtcaggtacaggagcgcgaccgacagcacggccatgcacgcgacccgcaggattgaatagtcgatgctgaagatcgcgatgccaagcacgagcccgatcacgatcgtgacgatcagcagcagcgcggccgcgagcacgacgctcgtcacgcggtcggcacggatcatgaagaacacgacgtacgcggacagcgcggcttcgggcgtgccgtatgcggccgtcacgaacgcggtcagcgcgcagatcagtgcgacccgcgcggcaatcgacgcgcgccccggaaacggtgcgagcagccgcaggacttcgcgcgggcccggcgagcgaacctcagcggcaggcagtgccatgccggacctcgacgatcgcgctggcaccgacgcgcacgagcgtgccgtcgggttcgtcgagcttcacgcgcaccgggaagcgctgcgcgacgtgcacccagttcaccgagttctgcacgatcggcagcgagcgcggcaggttgatgcgcgcgctgtcggcgatgccggcgccgatgccgacgaccttgcccgtcagcgggcggctgcggtcgatcatcgaatagacggtcgcgcagtcgccgaccgcgatgcggctcagtgccgtctcgcggaaattgccgaccgcgaaccattcgcgtgcgtcgatcagcgtgaagatcgactggttcggcgcgagggtttcgccggcgagaacggtcaggcccgtcacgagcccgtcgtgcggcgcgcgcacgaccgtgtcttcgagcgcatgctgcgcgcgcgccagcgcggcctcgcgcgcatgcagcgtcgcgatcgcgtcggcttcgtcgccgatcgtctgcgcggacgcgcgctgctgttcctgtgcctgcgtgagcgacacggctgcgtcgcgctggcgaaccttcgcctggtcgaactgctgcgcgctgacgtagccctgcgcggcgagcggggcgagccggttcacgtcgcgcgtcgcgagatcgtggttctgcgtcgcgcgcttgacctgctcggcggccacggccgcgttcgagcgctcgccgatcagcgaacggcggcgcgtgtcgagcgacgcgcgcgcgagctcgagatcggcctgcgcctgcgcaacggtcagacggtacggcacgggatcgatcacgtacagcaggtcgcccttcgcgacgcgctggttttcatgcaccgcgagctgcacgatgcggccgccgaccggcgacgcgacgtgcacgacgtccgcgtcgatcgacgcgtcgtcagtggacgggtaggccgtcgttcggtagtacgcgtacgcgagtgcggcgatgccgagcgcgacgatcgcgagggcgatcacgcggcctttgacggaggggcgggcggtgccggcggccttcatgcgaacggccccgtgccggtgagccacacgatcacggcgaccacgagcccgatcgcggtgcagacggcaagctggtagggcaccgtggcggcccagccggtcgagacgaatacgcggtgcgcgacgatcgcaccgatcacgccgacgatcgcgctgacgagccaaagcgggaaatatgcgccgaacaggacgtacgacggtgcaccgcgcgatgcgcagcccgcgagcggcagggctggcgcaaggacggcggcgacgcgcaaggcgcgcgcggcgttgtttttctcatgatgtgacgagctcgacggtgggggtggatgccgggcgcggcgcaatgtggatcgtcgccgcgacgacgattccgggatacggagccgataataaatcagcgcgatgcggatcgccagccatccttcctgctcaccatggcggggcggtggcggttctggggcgtgtccgcatggccggcatcgcgtttccgcaaccggggcagcgcagaccgggtcgtcgcgattctgccagtgcgggctcgcgtagggttgctaacggactgtaaaggatcgtcagacgaacggagcgtggctgaatttgcgatgtcgggagagcggaatcggtgcggaaacgggcgattgtcgttctgacgcgcgggaatcaggctgacctggcgggccgatgagggcgcggtcgcacgccgtgccggacggcatcgacgccaaatccggcgaccggtcgtcgccgccgcgatctgtgtaccatcgtacgcatggcgcggcgcgcggaacggagcctcacggcctcgtgcaacgcacgtcgcggaagcgtcaaggccgtatcgcaacgaaggtgaacgttccatgcgaagtttttgtccggttcattgcaatcggcgtgttgttccatctgtacgtcgggatgcggatcattcccgatgcgttcgcgtcgccggtcgtgcgcacgatcgcggcgctcatgctggcgagcttcgtcgtgctgattccggtcggcatgttctcgcgccgcttcgacgaaggctgggccgcgaccctggtcggctgggccggctcggtcgtgatgggcttcttctcgtcgctgcttctgctgacgttcctccgcgaattcgtgctgctcggcgtgtttgcatggcggcatctcgggcacgacggcgcgtggcccggcgcggcgaccggcacggcgctcggcgtgctggtcggtgcggtgttcgttaccgtggtcgggttcgtcggcgcgcgccgcacggcggcggtcaagcgcgtgtcgatcccggtcgaggggctgccggcggggctcgacgggctgacgatcgtgcaactgtccgacatccacgtcgggccgacgatcaagcggccctatgtcgaacggatcgtgcgcgcggtcaatgcgctcgatgccgacctcgtcgtcgtgacgggcgacgtggtcgacggctcggtcaagcgcctgcgcgagcacacggcgccgctcggccgcatgcagtcgcggcacggcagcttcctggtgacgggcaaccacgagtattacgcgggcgcgcacgcgtggatcgacgaattccggcgcatcgggctgacggtgctgctcaacgagcacgtgctgatcgatcacgacggcgcgcacgcggtgctcgcgggcgtcaccgacttcacggcgggcggtttcgatcccgcccatcgcagcgatcccgagcaagcgctggcgggtgcgccgcgcgaggtggccacgaagatcctgctcgcgcaccagccgcgcagcgcggaagcggccaaccgcgcggggtttaccgtgcagttgtcggggcacacgcacggcggccagttcctgccgtggccgccgttcgtgcgattgcagcagccggtgatcggcgggctgagccgtttcggcgatctgtggctctatacgagccgcggcaccggatactgggggccgccgaaccgcttcggcgtgccgtcagagatcacgctgatccggctgacgcgcggcgggtagcgcacggtttccgtccgggaaaccattcgcggggccggcgcaagcccgtcgtcggcgggaaccgggcgggcggcagcctgcctcgtctgcgaatgacagcgcatggcggcgtgcgacgccgttggctagtatgcaggcatgcaccgttcgctccgctcatcgcccgttcctcccgacatgtcgacgcccgatctctttgctgacacgcccgctcccgacgtggactggtacccggactggctggcgccgcccgatgccgatcgcgcgctggccgcgctgatcgacgaggtcgcgtggcgtcaggacacgatccgcacgccgcgcggacgcattccgttgccgcgactcaccgcatggcagggcgagccggatgccgtctacgtatattcggggatccgcaacgtgccggcgccgtggacgccggccgtgttcgacctgaagcgcgcggtcgaggcgacgtgcggcgcgcgtttcaacagcgtgctgctcaaccgctaccgcaacgggctggacagcctcggctggcacgcggacaacgagcccgagcttggcgatgcgccggtgatcgcgtcggtgagcctcggtgcgatgcgcgtgttcgacctgcgccatcgcgcgaccggtgtcacgcatgcgtatcgcctcgtgcacggcagcctgctcgtgatgcgcgggcgcacgcaggccgaatggcagcatcgcgtgccgaaggcgccgggcgtgcagggcgagcgcgtgaacctgacgttccggcgcgtgatgccgggtggtacggatcggtaacgatcctcgtcgccgaggcggccggatcgccgggcgattcgcgccccgtttctttgcggggcacgggcgaccgacacacgcaagcggtcgcgtgtgcggcacgttgccgcacgaatgtcgcgccgtgcgccgcgaaacggtgctgagccccatcccatatgggtttcaggtagattcgatcgaccgcccggtaccgatagatgagtgaaacctctgatggtgcgtcgcaacaatccttgactagactgtcgaatggcagaagcgcgtcgtatcccggcgcgaccctttcgacatgccccgagcgtcgccgatgcggcgcgcaagggggcaggagtaaaacgcgtgaccgtaatcgacccttccttcgaaccctcgctgcacgtctttgaacaagacggcggatggcaatgggcgctgacggtgaagcgggcgaccggcgtcggcgtgaaagtcgttgcgttcagccgggaaggctttcgcggcgaggccgaggcttatgccgccggccagcttgcccgcgccgagtatgacgccgccgtgacggcctgacgccgtcgcggcgattccgcccgaggatcgccttcaccgctcaccacccgctgccgggtgtttctttcgatcgcttcccgttttccatccgtttgcccgcccgccgggccgcgttgtgccgtgctcgtcgcgcgacagcggatgcggcgcgcccgggtgcctgtccgtccgggctgcccgcgtcaaatggtccgtaccattcgacacgtgtgtgccatacgcggcgcttgacgtccgtgcacggcgtccgtcgcgccggcgatgcggctgcgtgccgcgccggcatcggccgcccgcatgccgtgacgcccgggccggaatgcgggcgtggccggatatcgtaataacatatgacgttattgcgtcggcaggacgatgacgtcctgcttcttcacgaggagccacccatgcaactgagccagttaggcgggcacgtcgcccaatccggtttcgccgaacggcagaagcacgcgcaggcgctgatgttcggcatggccgacatcaacgaatacgtgtccggcggcgtctgttatgacgccgcggcctatgtccggtatctgctgcgcagtgacgcgatgatcgcgcccggtgcgctgctcgacacgatcggccagcactggcggacccgcttcaacttcgagaccggcggcgaatgggacgggcgcgcgagcattccggccggaaccgcggtcggcttctcgcggggcggcaccgtttttcatgccgcgatcgccgtcggcggcagccggatccgggcgatcaacgggggcctgggcagcggctggatgtacgcggtcgaccttgcgcgggtgctcgagccggacgcggccggcggattcacgtatgaccgcgcgaacatccgggttcacctgtcgcgcctgtaggcggcgcggcttcggctgccacgccggccgccgcgcgccgcgcccacggccggcatcgcgtcgtccggcgatttccgcatggcgccgcgctgtccatcgctgctatcctctcgaccgtgaatgactattcgtggggccgtggaagcgcatgccgcgccgcggcgattcacgcgggtgcgagcccgcgtgcgcgccgggctcgcatggccgcctgtccacgacgatccatgacccgtttcgtgattgatttccttccgtccatgtccacatggtcaagacaacgatgagcgacgcgcctgaatccgcggcgcccggcgacgacgaatcgtccggcggcgcatcgtcctacctggtgccggggctcgaacgcgggctgcggatcctcgccgaattctccgcgcgcgagcccgtgctcggcgcgcccgagttgtcgaagcgcatcggcattccgcgcacgaccacgttccgcctgctgcagacgctcgaagcgctcggtttcctcgagcgcgtgaacggcgaccgttatttccggctgggcgtcggcgtgctgcggctcggcttcgaatacctgaattcgctcgaactgaccgatctcggcacgcccgtgctcgagcggctgcgtgatacgacggggctgtcgacgcatctgctgatccgcgaccagcgcgacgtcgtgttcgtcgcgaaggcgcagagcaacgcgtcgatgttcggttcggtgaaggtgcacgtcggcacgcgtctgcccgcgcatgcgaccgtgcatggccacgtgttgatgggcgacctgacgcgcgacgcactgcgccagctctatccggagaaaaactcgaacagttcaccgagcgcacgccgggcaccgtcgacgaactgtacgagcgcgtgcgccattacgcgcggctcggttatgcggtcagcgaggcggcgttcgagagcggcatttcggcggtcacggcgcccgtgcgcgatcactcgggctcgatcgtcgcggcgatcaccgcgacggtgccgcgctcggagatcggcgaggccggcgagaaggaacggctcgtcgaagccgtgtgcggcgcggcggtcgacctgtcccagcgcctgaactatcgtccgctcgaaagcgacccgacgttcgcgcacgcgcgccacaaggtcgcgatgttctgacgccgacttgtcgggcgggccgccgcacgcggcaccgcaatcaaaaacgagggcccgcgggccctcatttcatttcaggcaccgactgcctgacgccgttcagaacgagtggtggatcccggtgagcacgaccacctggttcgcggtgctcgacacgccggccgtgaagaacgcggcctttgcaccgcccgaaccgtgctcgtacagcacgttcgcataaagctgcgtgcgcttcgacagcgaatagatgtcgccgagttcgacctgcgtccagcggcggccggccagcgtcgtcgttgccgcgccgcccgcgatcgtgttgaacgcgctgctgcggtagttcacgcccgcgtcgtagctctggaacgtgtccgaatagccgttcgactgcattttcgtgcgcgtgtacaggccatgcacgaggaagtcgccgaactggtaggacgcgcccgcgccgatgttctcgaccttgttcgcgatgtagccgttcgcggtgttctgcccctggaacgacgtgatgccggtcgtgctgatcaggatcgagcggtcgtgctcgttcgagtacacggccgacgccttgaacggcccgttcgcatagttcagcgcgacgccgaccgacttgccggtcgagaagttcgtcgtgttgccgagcgccatcgtcgccgcagccgagaagcccgcgaaggtcggcgaacgatacttgaccgcgttgttgtacggcacgttgccggtcgcggcgagcccgtcgatgttgccggggtggaacgcataccagctcatcgcgaggtaggccgtgctgagcggatcgagatagtcgaacgacaacggcgtctggcggccgagcgtcagcgtgccgtagcgttccgagctgaggccgacgaaggccgcgcggttccagatcgtgttcgcggtcgcgaactggccgttgttcgtatagaagccgttttcgagctggaagatcgccgacaggccgtcgccgaggtcttccttgcccttcaggccccaccggtcgggctgcgtattgccctggatcatcgcccatttcgcatggccgccgacgttgttcacgtacgcgacccccgcatccatgctgccgtacagcaccacgctgctctgcgcccacgcgcccgacacggcgcccaatccgatcactgttgctgctaccgcatgcttgaccatttgatctcctgaatctccaacctgatgaaaacgtgccgtggcggcctgcgcgggaacggcctgccgttgcgcgtcttcgccatcgagcgggcatttttatgttccatacaaggaacaacgtgcctctgatggaatggagtataggggcgtcgagcgccgtatcaaaaataatttttcgggacggatggaatccgtgccggtgcccggttgcggtgcacgacgcccgaaaaaggcggtaaatgcccgctgcacaacaaaaattacatttggcaaggcaggcggaagtgactgccgacccgatggtcggtgttttcctaggacgtgcagctttttgttttactcgtgaaaagtcgctcctataatcaccatccataaactgctgttccggatatggaacaaatcggaacaaaccgagagtcgatcagaaggaagggtgtgagatgtctgaacaatggatttgcgccgggcacgccggcgcgctgtcggaagacacgccgatcgagttcaagcggaccgacggcgtcgaaatcgggatctaccgcgtcggcgacgacgtgtatgcgctcgagaacgtgtgcccgcatgcgtacgcgctgctgacgcaggggttcgtcgacgaaggcacggtcgaatgcccgctgcacgaggccgtgttcgacatcaggacgggcgaatgcctgaaaggtccgggcgggcgcgcgctgaagcagtacgcggtgcgccttgccggcgaggaaatccagatcaaggtggagtaaccgatgaaagaagcgaccgtcaacttcaatcccttcctgaagccgtgggtggcgccgcagccgaacaacgtcgcgggcaaggggcagatcgagatccccggccaggtcgagaaccaggtctggcagaaccgcaaggccgccccgacccagtacgaaaacgacctcggcgatgcgctcgaacgcgtgttcgaagccggcgcgaccgagctggacgatgtcgtcgcgggcctgaaccgcatcggcttccgcgcaccggacggcacggcgtggaccgccgagcgcttccgcgccgaaatggcctcgctcgcggaatgaccgcgccgagcgcgtgaccgccgacccgacgacaaccgcatccggagcacactgatgacgtccccgtacaacacgcagtccaacacgacccggtccgtgactatctcgaccgcggcatcaagaactactggtatcccgtcgcaccgagctggcaggtgtcgaacgcacccgtcggcctcacgcgcctgtccgagcagatcgtgctgtggcgcgatcacgaaggcaaggttcacgcactcgaagatcgctgcccgcaccgcggcgcacgcctgtcgctcggctggaacctcggcggcaacatcgcgtgctggtatcacggcatcgaagtcgacggcggcggcacggtcaaccgtgtgccggctgtgtcgaactgtccgctcgaaggcacgaagtgcgtgaagtcgtatccggtcgaggagaaggccggtgcgatcttcctgtggttcggcgacgaagcgcacggcgagccggcgccgctgaacctgccggaagaactggtcgccgacgaatacggccacttcctgtgcgtatcgaactggaagtgcaattaccagtacgcgatcgacaacgtgatggacccgatgcacggcgcgtacctgcacgcgacgtcgcattcgatggccgaaggcgacaagcaggccgacatgcgcgtgcgcaagacggaaacgggcttgatgttcgagaagatcggccagcgcgacgtgaacttcgactgggtcgagctcggcgaaaccggctgcctgtggatgcgcctcgcgattccgtacaagcagaagtttggccccggcggcaacttcgggatcatcggcttcgcgacgccggtcgacggcgacaactgccaggtctatttctggcgcacgcgcaaggtcagcggctggcagcgcgacgtgtggcgcttcatgtaccgcaaccgcctcgagggcctgcactgggacgtgctcgagcaggaccgctacgtcctcgaaagcctcgcgccgcacgcgcgcgatcacgaatacctgtaccagcacgacgtcggcatcacgcgcgtgcgccggatgctgcgccagcgtgcgcaggagcatctttccgcgctcgacgcgcatcgcgcggcgcaggccgcggcggagccctcgaatggctgagctcgctccggtcgtgtcgctgccggggcgccgcgtgctcgtcacgggcggcgcgcgcgggctgggcgcggcgttcgtgaaggcgctggtcgcggcgggtgcgcaggtcgcgttcggcgacgtgctcgccgaagagggccgcgcgctggccgcgcaactcacgcaagccggccacaccgcgtttttcttcgcgctcgacctggccgatccggcgagcgtcgacgcattcgtcgcgcagggcgcggcggcgctcggcggcatcgatgcgctgatcaacaacgcggcgatcacgaactcgggcggcaaattgtcgacggagctcgacgtgtcgacctgggacgccgtgatgaacgtgaacgtgcgcggcgtgtggctcgtcagcaatgcggcgctgccgcacctcgcgcagtcggggcgcggcgcgatcgtgaacctcgcatcggacaccgcgctgtggggcgcgccgaagctgctcgcgtacgtcgcgagcaagggcgcggtgatcgcgatgacgcatgcgcaggcgcgcgagttcggcgcgcacggcgtgacggtcaacgcgatcgcgccggggctgacggaagtcgaggcgacggcctacgtgccggccgagcgccacgcgttctacatgcagggccgcgcgctgacgcgcgcgcaggtgcccgacgacgtgacgggccccgtgctgttcctgctgtcggacggcgcgcgcttcgtgacgggtcaactgctgccggtgaacggcggcttcgtaatgaattgaattgaagttttcactctgatgaaggagaggacgatggcggacgccgatctcgaacgcaagtcgtgggaccagccggaaggcgcaagcttcaacgactggatggaagggcgcgttgctcgctacgcgacgcggcgctacgactgggacgcactgaagttccaggccgactacgacccgaagtaccgccgcgcgcagatgcgctacgtcggcacgggcggcacgggcgtcgcgaaggacgtcaacacggtgccggccggcaacttcacgttctcgacgatggtcatcccggccggcaacatcggcccgagccacatccacatcgacgtggaagagatcttcttcgtgctgcgcggcaagatgaaggtgatctgcgagcgcgacggcgagacgtgggaagcgatcctcggcgagcgcgacctgatctcggtgccgccgggcgtgtatcgcacggaaatcaacatcggcgaggaagatgcgctgatgtgcgtgatgctcggttcgccgaagccggtcacgccgacgtatccgcccgattcgccgctcgcgaagatcaagcgctgagacgggacgggtgaagcaatgagtgtcatcgacaaacgtgagcgcgaccgcaccgcggcgttcgccgcgctgctcgggcagtttcccgagcagcgttgcgcggccggcgcggcgggcacgatcggctaccgtgaggccggcgcgcagcacgcgggccgtgcgctgcccgtcgtgctgctgcacggcatcggctcgggcgccgcatcgtgggttcgccagctcgacacgctcggcgcgtcgcggcgcgtgctcgcgtgggacgcgcccggttacggcgtgtcgacgcccgtgcacggcgcgtcgccggccgccgccgattacgcggcctcgctgaacgcgtggctcgaggcactcggcatcgaacgctgcgtgctggtcggccattcgctcggcgcgatcgtcgcgggtggtctcgcccgcgtgatgcctgcgcggatcgccggcctgctgctggtgtcgcccgcgggcggctacggcagcgcaccggccgaaacgcgcgaatcgcgccgcgacgcacggctcgcgatgctcgccgaactcggcccggccgggctcgccgagcagcgcagcggcaacatgctgtccggtttcgcgaacgaggaggcacgtgcgtgggtgcgctggaacatggcgcgcatcgtgccggccggttacgcgcaggccacgcatctgctcgcgaacgccgatctcgcggccgacctcgccggttttcgcggtcgcacggccgtggccgtcggcgcgaacgacgcgatcacgccgcccgccgcgtgcgagcggatcgccgcggccgcgcacgtcgggctgcaggtgattccgcaagccgggcatgccggttatgtcgaggctccggccgtttattccgcactgatcgactcgttctgccgtcagtgcgaccaacagcgggggctggcatgaacgaaccgctgcaacgacccgaacccgaaaacgacaaggccgaagccagctacgtggtgcccggcctcgaacgcgggctgcggatcctcgccgaattctcgccgcgcgagcccgtgctcggtgcgcccgagctgtcgaagcggctcggcattccgcgcacgacggtgttccgcctgctgcagacgctcgaatcgctcggcttcctcgagcgcgcggacaaggatcgcaactacaagctcggcatcgccgtgctgcggctcggcttcgaatacctgagctcgctggagctgaccgatctcggcctgcccgtgatcgagagcctgcgcgacgccaccggcttcacgacgcacatcgtgatccgcgacggccgcgacgtggtgttcgtcgcgaaggcgcagagccagtcgccggtgttcagctcgatccgcgtgaacgtcggcacgcgcttgcccgcgcatgcgacgacgcacggccacgtgctgatgggcgacctgtcgctgaaggaactgcatgcgctgtatccggaaggcacgctgaaccggatgacgaacgcgacaccggaaacggtcgacgcactgtacgaagtgatccgcgaggatgcgatgcgcggctacggcgtcagcaattcgtcgttcgagcgcggcatctcggtggtcacggcgccggtgcgcaacgagacgcagaagatcgtcgcgtgcatcacggtgacggtgccgcggccggaaatcgacgcggcgctgatcgcggacgggctgatcgacaaggtgcagcgcgcggcggcggaactgtcgcggcggctcaattaccgctcggatgacgagcacacgtttatgaaagcattaggactccgatgatccagatcgatctgaccgggcaggtggcggtggtgacgggcggttcgtccggcatcggcctcgcgaccgccgaacggttcctgcaggcaggcgcatcggtcgcgatttgcggccgcgacggcgagcgcctggcgcgcgccgaggcgatgctcaacgaaaatacccgggcgcgcaactgctcgccgcgcgctgcaacgtgctcgacgagcacgacgtcgccgcgttcgcgcaagcggtgtccgcgcgcttcggccgcgccgacatgctggtcaacaacgccggccagggtcgcgtgtcgaccttcgcggacacgaccgacgacgcgtggcgcgacgagctcgaactgaagtatttcagcatcatccgcccgacgcgcgcgttcctgccgctgctgcgcgatgcgcaggcgccgacgatcacctgcgtgaactcgctgctcgcgctgcagccggagccgcacatggtcgcgacgtcgtcggcgcgcgcgggcgtgctgagcctcgtgaagtcgctcgcgaacgaactcgcgccgcagcgcatccgcgtgaactcgatcctgatcggcatcgtcgagtcgggccagtggcgccgccgttacgaagcgcaggcgcaggccggcgaaagctgggaggactggacgggcgcgatcgcccgcacgaagcacattccgctgaaccgcttcggcaagcccgacgaggcagcctgggcactttttatctcgcaacgcatctgtcgtcctacacgacgggcagccatatcgacgtttctggaggctttgcacgccatgtctgaaaaaccacggttggcgagctgattgccgcctttctcgagcagtgcggcgtgaagaccgcattcggtgtcatctcgatccacaacatgccgatcctcgacgcgatcaactcgcgcggcaacatccggtacgtcggcgcacgcggcgaagccggcgcattgaacatggccgacggcctggcccgcgtgtcgggcggcctcggcgtcgcgttcacgagcacggggacggcggcaggcaacgcggcgggcgcgatggtcgaggcgctgacggcaggcaccgcgctgctgcacgtcacggggcagatcgagacgccgtatctcgaccaggatctcgcgtatatccacgaagcgccggatcaactgtcgatgctggactcgatctcgaaggccgccttccgcgtgcgcaccgtcgaaaccgtgctgccgacgatccgcgaagccgtgcgcatcgcgcagacggcgccgacgggcccggtgtcggtcgagattccgatcgacatccaggcagctgaaatcgaatggccggaagacctcgcaccggcgcacgtcacggtgcgcgagcacgattccgcacgcgtcgcgaagctcgccgacgccctcgcggcgaagcgccgcccgctgctgtggctcggcggcggcgcgcgccatgcacgcgcggaagtcgagcgcctcgtgaagctcggcttcggcgtcgtgacgagcgtgcagggccgtggcgtgctgccggaggaccacccggcgacgctcggcgcgttcaacgtgcacgcgtccgtcgaagcgttctacaagacttgcgacgcgctcgtcgtcgtcggttcgcgcctgcgcggcaacgaaacgctgaagtacaagctcgcgctgccgcagccgctgttccgcgtcgatgccgaggcactcgccgacaaccgcggctatcgcaacgagctgttcgtgcatggcgattcgaagcgcgtgctggccgagctggccgaccggctcgaaggccgcctgtcggtcgatccgcagttcgcggccgatctcgcggcagcccgcgagcaggcggtggccgacgtgtcgaagggcctcgggccgtacaagaagctggtcgacacgctgcaggggcggtcggccgcgactacaactgggtgcgcgacgtgacgatctcgaacagcacgtggggcaaccgcctgctgaagatcttcgagccgcgctcgggtgtgcatgcgctcggcggcggcatcggccagggcatccagatgggcatcggcgcggcgctcgcgggcgcggcggccaagacggtctgcctggtcggcgacggcggcctgatggtcaacgtcggcgagctcgtgacggccgtgcaggagaacgcgaacgtgatgatcgtgctgatgaacgaccagtgctacggcgtgatccgcaacatccaggatgcgcactacggcggccgccgctgcttcgtgcaactgcaccaacccgatttcgcgcagttctgcgcgagcttcggcctcacgcactaccggatcacgtcgctcgacgacgccgaggcgatcgtgcgcgaagggatggccaaggaagggccggtgatggtcgaggtcgacatgctgtcggtcggctcgttcgcgtcgcagttcgcgggcccccggtgaagaaggaagcgccgacggagcgccagtatgcttaacgggcaaaagcgggcccacgcccccgtcgacgtcgcgatgatcggcttcggtgcgatcggcgcggccgtgtaccacgcggtcgagcacgatgcgtcgctgcgcatcgcgcacgtgatcgtgccggaacaccagcgcgcggcggtgcagggcgtgctgggcggcgcggtggaggtcgtgtcgtcggtcgacgcactggcccgccgccccgagttcgcgctcgaatgcgcgggccacagcgcgctcgtcgatcacgtcgtgccgctgctgaaggccggcaccgactgcgcggtcgcgtcgatcggcgcgctgtccgaccttgcgctgctcgacgtgctcgcgcaggcggccgacgaaggcgacgcgacggtcacgctgctgtccggcgcgatcggcggcatcgacgcgctggcctccgcgaagcagggcggcctcgacgaagtgctgtacgtgggccgcaagccgccgctcggctggctcggcacgcccgccgaggagatgtgcgacctgcgtgcgatgagcgaggcgaaggtgatcttcgaaggcaccgcgcgcgacgccgcgcgcctgtatccgaagaacgcgaacgtcgcggccaccgtggcgctcgcgggcctcggcctcgacgcgacgcacgtgcgcctgatcgccgatccggcggtcgagcgcaacgtgcaccgcatcaccgcgcgcggcgcattcggcgagatgtcgctggaaatgagcggcaagccgctgcccgacaacccgaagacgtccgcgctgacggcgtacagcgcgatccgcgcgctgcgcaaccgcgcggcccgctgcgtgatctgaccgggccattgaatgtccgcccgcgccaccgcgagggcggacgtgcagagacagatttgtgggacttgtgacatgactcctttcgatacgagcctcgtgcccgacggcaacatcctgatcggcggcgaatggcggcgcggccgtggcgcgccttacgcgagcatctatccggccgaccagtcgctgaacatggaagtgtcgacggcgaacgcggaagacgcggccgaagccgtcgtggccgccgacgccgcctggcgccgcgccgactgggccgggctgaagccgcacctgcgcgcgcaggtgctgtaccgcatcgccgacctgatcatgcagcgccacgaggcgcttgcgaacctgcagcgccgcgacaacggcaagccgatcggcgagacgcgcgtgctggtggcgagcgcggcgaacacgttccgctattttgcggcgtgcctcgaaacgctcgacgaggaactgacgccgtcgcgcggcgactacctgacgatgagcgtgcacgagccgatcggcgtgatcgcggcgatcacgccgtggaattcgccgatcgcgtccgacgcgcagaagctcgcgccggcgcttgccggcggcaatgcggtggtgctcaagccggccgaggtcacgccgctcgtgtcgctcgcgctggcccgcatctgcgaggaggcgggcgtgccgaagggcgtgctgagcgtgctgccgggcaagggctcggtgatcggcgacgtgctcgtgcgccatccgctcgtgaagaaggtgtcgttcacgggcggcacggaagtcgggcgcggcatcgcgcgcatcgcggcggaaaagctgatgcccgtgtcgctcgaactcggcggcaagtcgccgacgatcgtatgcgacgacgccgatctcgatcatgcagtgaacggcgtgctgtacggcatcttcagctcgtcgggcgaagcgtgcatcgcgggttcgcggctgttcgtgcagcgcgcggtgtacgacgaattcatgaagcgcctggtcgcgggcgcacgcaagctgcgcgtgggcgacccgacgcgccccgacacgcagatggggccgctgatcaccgcgaagcatcgcgagtcggtagagcgctacgtggcgctcggcctcgaggaaggcggccgcctgctgtgcggcggcgagcggccgtcgggcgacggtcgcgagaacggcttcttctatcagccgacgattctcgaaggcctgccgaacagcgcgcgcatctgccaggaagaaatcttcggccccgtgctcgtcgcgatgccgttcgacgacgaagcgtcgctgatcgcgcaggcgaacgacagcgtgttcggcctggcagccggcatctggacgcgcgactacaagcgcgcatggcgcatcgcgcgcgcgctggagacgggcaccgtctggatcaacacgtacaagctgttctcgatctccacgccgttctcgggctggaaggagagcgggatgggccgcgagaaggggcgtctcggcatccgcgagtacatgcagcagaagagcctctactggggcttgaacgacgcgccgctgccgtgggcgaactgagcgaaggggaaaacgcaatgagcattctgggaatcgagcagatcacgtacggggtcgacgatctcgccacctgccggcgctttttcgccgactgggggctgaaggaagtcgagcacgacgacacgcaggcgcgcttcgagacgttgaacggctgcaccgtgctggtcgtcaaggccgacgacccggcgctgccgcccgcgttcgaagcgggcccgacgctgcgtgaagtcacgtggggcgtcgcgacgcagcaggaactcgacgcgctgcgcggcaagtttgcaggccagcccggcttttatgcgcggaaggatgcgttcggttgcaccgacccgaacgggatggcgatccgcatcgaagtcacgcgcaagcgcgcactcgacatcacgggctcgccgtcgaacgtgtggggccgggcgctgcgcgtcgaccagccgagcccgatctatgcgcgtgcggagccggtcgaggtcgggcatgtcgtgttcttcacgaactgcctcgacgcgcaggaaaagttctatcacgagctgctgggcttcgagacgtccgaccgctacccgggccgcggcgcgttcatgcgctgcgcgccgcacggcggccaccacgacctgttcctgctcgcgctgccgaacggaaaacgcggcctgaaccacgtcgcgttcaccgtgcgcgacatccacgaagtgttcggcggcggcctgcacatcgaccgctgcggctgggaaacgcaactcggcccggggcgtcatccggtgtcgtccgcgtacttctggtacttccagaacccggccggcggcctgatcgagtactacgcggacgaagacatgctgacgcccgagtggcagccgcgcgaattcgaaccgggcccgaccgtgttcgccgaatgggccgtcgacggcggcctcgacggcaacacgcgccggcagaagcacgcgaaggcgccggaaggcaagttcatgacggagcgcaaatcgtgagcgaagagaacgcacaggcgcacgccgcgccgggcacggtcgtcgtgatcggcggcggccaggccgccggctgggtgctgaagacgctgcgcgcggaaggttttgcgggccgtctcgtgatgatcgccgacgagccgcatctgccgtacgagcggccgccgctgtcgaaggccgtgctggccggcgacgccgacatcgaaaccgtgcgcgtcgtgcgtcccgacgagttcgacgcgctggacgtcgaggcgtggcagccggaacgcgccgcatcgatcgaccgtgcgcgccgcgtggtgcgtaccgaaagcggccgcgagatcgaatacgaccgcctcgtgatcgcgaccggcggcacgtcgcgccgcctgccggacgcgctcgtgaagacgccgaacctgcattacctgcgcacgctcgacgaagcggccgcactcggcgagaagctgcgcgcgagccggcgcgtgctcgtgatcggcggcggctggatcggcctcgaagtcgcggcgaccgcgcgcaagctcggcgtcgaggcggtcgtggtcgaaggcacgccgcggctgtgcggccgctcggtgccgcagatcgtgtcggatttcctgctcgacctgcatcgcgcgaacggcgtcgacgtccggctcggcgcggcgctcgcgtcgctcgacgcccagccggacgatgcgtcgaaggtacgcgcgacgctcgccgacggcacgacgatcgacgccgatttcgcggtggccggcatcggcctcgcgctgaacgcgtcgctcgcgagcgacgcggggctggcgatcgacgacggcatcgtcgtcgacgaattcggcgcgacgagcgacccggcgatcttcgcgtgcggcgacgtcgcgaaccatcacaacggctggctgaagcggcgcgtgcggctcgaatcgtgggccaatgcgcagaaccaggcgatcgcggccgcgaaggccgtgctgggcgtgcgcgcaccgtacgcggagattccgtggttctggtcggatcagtacgacgtgaacctgcagatcctcggcgatctgccggccgatgcgcagctcgtcgtgcgcggcgagcttgccgcgcgacgcgcgacgctgtttttcgtgggcgaagggcatgtgagaggtgtcatcgccgtgaacaacgcgcgtgagctgaagctcgcgcgcaagtggatgaaccagggccgggcagtggatacggaagcgctggcagacacgagcaagacactggcctgaccgggcgacgaaacccaggagatcctccgcatgagcactttcgacaatgtcgtggccggtcgcgccacgatggaagctgccgcctccacgcccggcgcgatcatcgcgcggctcgagcggcttccggccaacgcaatgcagatccgcgcccgcgtgctgatcggcaccgcgacgttcttcgacggcttcgacgtgatcacgatcgcggccacgctgccgctgctgattcacaaatggggctgtcgccgacccagatcggcctgctgatcgcgtccggcgcgatcggccagctgatcggcgcattcctgtttcccgcgctggcggagaagcatggccgcgtgaaggcgatcgcgtggagttcggccgtgatcggcatcacgagcatcgcgtgcggcttcgcgccgacgttcgaagtgtttgtgctgctgcggatcctgcaggggctcgggcttggcggcgagctgccggtcgccgcgacgtacatcaacgagatcacgcgcgcacatggccgcggccgcttcgtgctgctgtacgagatcgtgttcccgatcggcctgctcgtgtcgatggcgctcggcgcgtggctcgtgccgcgtttcggctgggagatcatgtacttcgtcggcgggctgccgctgatcctgtcgctcgtgctgacgcgcctcgtgccggaatcgccgcgctggctcgcgtcgcgcgggcggctcgcggaagccgggcgggcgacgagcgcgttcgaagcgtcggtgcgcggcgaactgccgcccgtcacgcaggtggccgcgttcgacgagatggtgcgccagcacccgaagcgccggatgagcgacctgttcagcgccgcgtatcgcaagcgcacgctcgcggtggcgacgttgtgggcgacctgcgggttcatccagtacgggctgtcgacgtggctgccgacgatctacaagaacttctatcacgcgccgctgcagctcgcgctgaacctcgcggtgatcggctcggtgatgggcgtgctcgggtcgctggcgtcggcgctgctcgtcgacaagctcggccgcaagccggtgatcgtgtggtcgttcgtgctgtgcgcgctgtcgctggcgctcgcgggcgtctatcacgcgtcgtcggtgtatgtcgtctcgatcttctgctcgctgtcgctcgggttgatggcgtcggggttcatcaccgcgtacgtctatacgccggagcagtatccgactagcatccgcgcgtcgggttgcgggctcggcagcgcatggctgaagatcgcgtcgttcgtcgcgccgatggtggtgccgcacgcgatcatcggcgggaatctcgcccccgcgttctacctgatcggcatcgtgccgcttatcgcggcggtgaccgtgcacttcgtcgggatcgagacgaagggaaggtgctcaagcgcttgaagcgtaggcgcggccggcggcggtaacggatgacgtggtgaggcccgggcgatgcccgggctttttttttcgcggtgatgttggcatggcgtggcgggccgtgcgagcgcgcggcgtggccgatttggggcttgcgtgttctaattcacgctcccgtttttcgatcgagtgttgtcatgcccctgttcgaacccgtcacgctggaaacatcccgcctcgtcctgcggccgctgcgcgaagccgacgcgcacgccttcttcgagatctggtcggatgcggaagcgatgcgctatttctcgttctcgccgatgacgcacatcgaacaggccgtcgagcgcgtcgcgcgcaacctgaagacgtccgcgagcgggcaggacctgatctgcgtgctcgaactgcgggaaacaggcgaagcactcggcgaatgcgtgctgttccatgcgaacgagcaatgccggcgtgccgaggtcggcttcagcctgcggcgccggtactggcgcggcggctacatgcgcgaggcggcgtcggccgtgatcgatcacgcgttcggcacgctgcggctgaaccggatcgaagccgatatcgatccgcgcaacgtcgcgtcggcgcggctgctcgaacggctcggcttcgcgcgggaagggttgctgcgcgaacgctggatcgtcggcgacgaagtgtcggacagtgcgctgtacgggttgctggcgagcgaccggcgcgcgtgaggcggccgggccggcgatggcccggtcaggtcaatcccggcggctgttttccatgtcggtcacgcgttggttgtacccgttcgcgtctgcgtactctcccgtctggtctctctgttgtcggccgcgcattctgttcgaacgctcacgatttcgcgagcaggccctcgacctgttctttcccgcgcagtgccgcgacccaccggtcgggtaacgcgtgctcgccgtacagcgcgccggcgaggctgccggcgatggccgccgtcgtatccgtgtcgttgccgagcgcgatcgcgcgcttcacgcagtcttcgtagctgcgcgtcgacaacaggcaatggatcgacgaccagaagctgtcgaccacgtaaccggacccttgcggcgcgtcgaagcggccatcgagcacgatcttcagttcgacttcgtctgtggtgcccgcgtagcgtgtgagcagctcgtcctcggccgcgcgcaccgcatccggcgccggcttgcccttgacgatgccccatgccgtcaggccgtaaagcgcacagcacagctgcgagcgcacgtggccgtgcgtgacgacgctctgcttgcacgcaagccggatcgtgtcgtcgcgcgaggcggcggccatcaccaccgggaagcagcgcatcagcgagccgttgccgttgtcgcgctcgccgtcagggccggcaacggcgggcgccgcgccggccgccagcgcatggaatgcacgctgcgtctgcaggccgacatcgaacacgcggccgtccggcgtgaaggcgccgcgatgaaaccagtcctgcaggttgcgggcgaacgtgtcgagattcaggtcgcggtcatccgcgagcgcgtcgagcagcgcgagcgcctgcgcgccgtcgtcgctccaggtgccgggcggcacgccgtcgtgagcacgcgcaaagccgggcggcggcgtcatgtcgatcgcggcgggcggcgggatcgacgcagcatcgtggaattcgtacggcacgcccagtgcgtcgccgatcagcaggccaagcaggccgccgcgcaggcgggattgtcggttcggaagggtcgtcatcggaggaagttggggttggcggctcgcgttgcagattagaccaatcgcattcgcgtgcctagccggcgcatgctggcgggccggaggaagcggtgcgcgcgaatcgccggaggtatgcttgcgagtcaggaccggattcgcagactgaccgcggagcgggtggcgtcgagtatggagcaacgacatgaaacagatcgtggtaaccccgcgtcgcagcgtattccgtcgacagtgaatgcgcggaagtgacgctatcctgcggcgagcacgagatcacggtgttctcgttcggcggcacggcgcgcgtgaacgacatcgtgcgaacgccggtgtcggcggtcgactgcgatgtacgcgcggcctgtcttgacgattggccggacgatgcaaagcgggcggccagccggcaatggatcgggaaaaccgcaaacccgtatggttatcgcggatgtgggcaggtcgtcgaccgggatcaggggttgatcgacgtggtcggcttcgtgatcgacgtgggcgagttgcgatgcggtggcgcggtcgaattcgagtgtctgcggctcgacctctgagcggccgatcgactgacggctttgccgggttgccggcgcaaacttacgcttggccggcaccccggcccacgaacaggatcgaccatgcaagcccatcctctgcgtctttccccggcgacgatctgcgccggtcgatcgaggaagcattgcgcccgctcggtgtgcacgcgggcttcgtgatccagggcatcggcagcctgagcgtcgcgcaattgcgcttcgcaggcgtcgaccagccgaccgaattgcgcggcgacctcgaaattctgacgctggccggttcggtgtcgccggacggcgcgcacctgcacatggccgtttccgatgcgagcggccgcgtgtcgggcggccatgtggcgagcggttgcgtggtgcgcacgaccgccgagatcctgctcgcgctgctgcccgcacatcgtttctctcgcgaacccgatgcgggcaccggtttcaacgagctggtgatccggcgagagccgggcggcgaaacggcatgaaaaagcgccgcaggccaccagcctgcggcgccattgaacggtgccgcgacgtgtcaaccgcccgtcgcagcccgtcgcgcgtgcttacatctgcacggtgtcggccacttccttgaagtcttcgatctggtcgaagttcatgtacttgtagatcttgtcgccgttggcgctgagcacgcccatgtccgccatgtactcttccttggtcgggatcttgcccagacgcgagcagatggccgccagttccgccgagccgagatacacgttcgtgttcttgccgagacggttcgggaagttgcgggtcgacgtcgacatgaccgtcgcgccttcgcgcacctgagcctggttacccatgcacagcgagcagcccggcatttcggtacgcgcaccggccgtgccgaacacgccgtagtggccttcttccgtcagctgcttctggtccatcttggtcggcggcgcgacccacagcttgaccgggatgtcgcgcttgccttcgagcagcttcgatgcggcacggaagtgaccgatgttggtcatgcacgagccgatgaacacttcgtcgatcttggcgccggcgacgtccgacagcgtcttcacgtcgtccgggtcgttcgggcaggcgacgatcggctcgtggatgtcggcgaggtcgatctcgatgacggccgcgtactcggcgtcggcatccggcgacagcagttgcgggtcggccagccactgctccatcgccgcgatacggcgctgcaggctgcgcggatcctggtagccctgcgcgatcatccacttcagcagcgtgatgttgctgttcaggtattcgatgatcggttccttgttcaggcgcaccgagcaaccggcggccgaacgctcggcggacgcatccgacagctcgaacgcttgctcgaccttcaggtcgggcaggccttcgatttcgaggatgcggcccgagaagatgttcttcttgccttgcttggcgaccgtcagcatgccttgcttgatcgcgtacagcgggatcgcgttgacgaggtcacgcagcgtgacgcccggctgcatcttgcccttgaagcggaccagcaccgattccggcatgtccagcggcatcgtgccggtggcggccgcgaacgcgaccaggcccgaacctgccgggaagctgatgccgatcgggaaacgcgtgtgcgaatcgccgccggtgccgacggtgtcgggcagcagcatgcggttcagccacgagtggatcacgccgtcgcccgggcgcagcgcgatgccgccacgcgtgctgatgaagttcggcagcgtctggtgcgtcttcacgtcgaccggcttcggatacgcggcggtgtggcagaacgactgcatcacgaggtcggccgagaagccgaggcaggcgagatccttcagttcgtcgcgggtcatcgggcccgtggtgtcctgcgagccgaccgaggtcatcttcggttcgcagtacgtgcccgggcgcacgccctggccttccggcagaccgcatgcgcgaccgaccatcttctgcgcgagcgagaagcccttgccgctgtcggccggctggtgcggcaggcggaacagcgtcgacggcgcgaggcccagcgcttcacgcgccttcgcggtcaggccgcggccgatgatcagcggaatgcggccgccggcgcgcacttcgtcgaacagcacgtcggacttgacctggaattcggcgatcacgttgccgtccttcagcgccttgccttcatacgggcgcagttcgaccacgtcgcccatttccatctgcgacacgtcgagctcgatcggcagcgcgccggcgtcttccatcgtgttgtagaagatcggggcgatcttgccgccgaggcacacgccgccgaagcgcttgttcggcacgaacgggatgtcttcgccggtgaaccacagcaccgagttggtggccgacttgcgcgaggagccggtgccgaccacgtcgcccacgtaggcgaccaggtgaccctttccttcagcgattcgatgaacttgaccgggccgcgcttgccgtcttcttccggcgtgatgcccgggcgtgcgttcttcagcatcgccagcgcgtgcatcgggatgtccgggcgggtggtggcgtccgggccggcgacaggtcgtcggtgttcgtttcgcccgtcaccttgaacacggtgatggtcaggctttgcggcacttccggacggctcgtgaaccattcggcgtcggcccagctttgcagcacggccttcgcgtgcgcgttgcccttgtcggcgagttccttgacgtcatggaactggtcgaacatcagcagggttttcttcagtgcgtcagcggcgacggcagcgaccgcctcgtcggacagcagctcgatcagcggctggatgttgtaaccgcccagcatcgtgccgagcagttcggtggcgcgttcgcgcgagatcagcgggcaggcggtctcgcccttggccacggcggccaggaagccggccttcacgcgggcggcttcgtcgacgccggccggcacgcgatgggtgatcaggtcgacgagcgtctgctcttcgccggcgggcgggttggtcagcagttccaccagttcggcggtctgctgagccgtcagcggcagggaggaataccgagcgcggcgcgggcggccacgtgagcacgaaagttttcaagcatggggagacctgctgatattgcgtttgaggggaaggccttgccggcactccggggctgttccaggcactgctttgagcgggattctaatctcaatgatctgtaacgtcaaatgtcttatgtcttatataagagttgagactttgggcatggaaaacgcggtggcgcggggagccggtgtttgcggatgtgcttcggcggctcgccggggcatgcctgcaggcgctgtctcgggtgttccggttgttgatgggaggagctggggcggcggtgtgcgtgaccgggatccggggtcgcccgtctgtgtcgggtcgcccgcggcgcggcgccgaacgctgtcgtgtgaacaggcaaggggcgcccgaggctgcggcccgcgcggggcgctaccggttacgaagcccgggagtccggaagcccggttgccggcggcgcacatttctgcacaagcacgcaggaaacggcacacacataccgctttcgggcgcctacgctgtatttcacgtgcctttcagcgagatttcaaaaacggggcattggcgcgtgccggccgcttcgtcgtgaacggccgaccgcgaaccctcaagtcccgtcaatccggaacatgcgatccagagaatcgattttcgttgtcctgtcgctcgtcgcgtcgtcgctcgttcatgcggcggcggccgacgacgaaacgcgcggcttcggcagccgtcccgtcgcactggtctatcgcggcccggccgcatgcgacggttgccccgagacgattgcgaggcgcctgcgggaatcggagcacaagttccgggtgctttacgtcgggccggcggaaaaacgccggatcacgcctgccgtcctggccggcgccgcgctgtatgtccagcccggcggcgggcaggacattccagcgcggcggccagcatcgggaaagactcgatcgaggccgtgcgccaatacgtgtcgaatggcgggcgctatctgggcatttgcatgggcgcctacctggcgggcgacccgggtttcgggctggtcgcgggcgagatcgactcggaggtcgaccggccgcgctcgacgcttcacggtatcgcggacacggtgacgccggtgatatggcgcgggaagaaacgctggatctacttccaggacggcgcgatgctcccggccgccccggcgcggccgtgctggcgacctatccgaaccgcgatatcgcagccgcgacctatcgctacggcaaagggcgcgtcgggctcgtcggcccgcatcccgaagccgacgaaagctggtatcgcgagtacggtctccggaatccggacggcgttctgccggacatggcgtacgacctgatcaacgcgacgatgaagccatgacgtggcgcgagctaattccgccgtgcgcgatacgcgtcgagattcttccgcgcctgtgcgcggatcgcgcgttgcacgaaaggcgtccagccgagcagcgcgcctttcagtccgagcgcctgacgcgcccagcgccacaggtcgaagctgtcgcgatgctcgacgatgcgcccgtcgcgaaaccggaaccgcgcgtcgatccggttgaccaccatccggccggtcgtggtgaaccggtaacgggcgatccattcggcgcgcccggcctgctgatccgcggcgacgtcgctgaacgtcaggaaaagtcctgcgcacgcgcgaccagcatgcgccacatgtcgcgggcgaggtcgccgcgcagctcgccgaacgcgggatcgctgaagacgacgtcatcggcgtagcaggcgagcatcgcgtcgatgtcgcgctgctggaacgccgtgtagaagcgctggatcaactcggtgtgcggatggctcatcgttgggtggggtgtcgttgcagatgaaacggagtctggccgcggcggccggacgttcgaccggttgatcgacgggggcgcgccatacggcaggaatgccccgatcgagcggatgtcggcgtgtcttccacgcgacgatgcgggtcacgcacgggcgttcggcatggccgccgtcctgaacgtgacatgcgtcgcgacatgtcgcgatatcgatcgaaacaagcgggcagtgatgagggcgtgcgcggcgcctccggttcagccctcgcgacccgaacccggccggagcgtcggcgaatgcacgtcagcggttcgccagcgccacgtcctggttgccgcgccccgtcaccaggcagcccgacatgaatgcctcgccctggctgctggccgctgcttcgccgaagccgcggccgagcgcgtcgaccttcacttgcgcggcgccctgttcgcatgcgagcgggctggtgtcgcggccctgcgcatgcaggatcgcgcgatcgccgatgagatatgccagcagcgcgaaaacagcgatatgtacggctcgtctcatggttcgtctcctcgtcgcacaagcgtaacgcggacacgttcgacgaagcacttggggttccccggtaaacgtctgctgaaacgggggcgggcggggtgatcgtgtcctgtttttcgcgtgttgcgtggggaacgaaggcgccgcttccatgcggccggcgggcgaaaccggacgtgcggcgacgcattcgcgcgacggttttcagcgcgacaggcccgcgattcgcgcgagtttgacgaatgtcaggagacgggcgggaggggcggccggacgaccgttcagagcgatagcatgaacgcatgatttgacggaacgcgatcgcggaggaatgcatcggttccggcaagcaggtgcgagttgaacatcgctgtcgaaatagtgaggaatccaaatgcttaacgtctcttccgtcctgatcagcctcgctccgatgtgggccatcctgctcgttgcgtcttcggcagccgcctatttcgtgttctggcgcaaggtcatcaagtaagcgcggcgggaacgccggtgcgtgcgtgggcggtaacgcggaacgcgcccgggtgtcgcaccgctcgctgcaaacctgcggtccgtcagcgaacggccgccatcgcgttgccgcgcgtgatcgccgtcattgcacggccgtgaccggcacgttcgagatccgcaccagccggctcatcacgctgcggcggaacaccgacatcagcgcatgcaacggatcgtgccgcggcgcgacgaccacgatctcgtcgcaccccgtctccgccgccacggccgcgatcgtatcggccaccgggccgaccttcatcacgatgctgtacttgacgccggcttcccgcaggatccgctcggccatggccaggtcggcggacgcgaacttctcctcgatcgaacgcagccgcgacagcggatggtaggcctcgagccgcgtcgattcgagcggcgcctgaacgttgatcagcacgatttccgacgcgcaccgttcgcgatacaggaatgtcgcgtggcgaactgcctgaagcgagcggggagtggccgaccggaaccagcagcttgagcatgaacgttgtccaggaaacgagatgattccagcgtagcgtgccgccgggacgaacgatctaaagagaacgggcgaccgcgtaaaaatgtcgttaacgcgcgccgtctcctgatgcgcctgatagaaatataagaaatttaagtttatgcgcataaacgatttcatccgcgagggcggcgcgtgcgaagcgtggcctgtcgccccgatttagtcggaaccgcaatgaatcgcggcggaaaatatcggaggttgccgatccggcgtcgcgtagagtagtgcatcggccgcggcgcggccccgcccggccgtttcgggggcgtctgccgccatgcggtccgccattccgttccgattccaggagactccgcatgccgcacggcgccccgcagcttctcgctcccgcttccatccccgtcgacccgatcgtgcgcctgtcggccggcgaactcgcgtcggcgattcgcggcaaggccgtgtcgtgcgtcgagacgatgcgcgcgtatctcgatcacgtcgagcgcgtgaacggcgcagtcaacgcgatcgtcgcgctgcgcgatcgcgacgcgctgctcgccgaagccgcggaaaaggatgccgcactggcgcgtggcgagtaccacggctggatgcacgggatgccgcaggcgccgaaggacctggcgatgacgaaggggctgcggacgacctacggctcgccgatcttccgcgaaaacgtgccgcaggccgattccgtgtgcgtcgcgcggatgcgcgcggccggcgcgatcttcatcggcaagaccaacacgcccgaattcgggctcggctcgcacacgttcaacgaagtctacggcgcgacccgcaacccgtacgacctgacgaagagcgcgggcggcagcagcggcggcacggcggcggcgctcgcgtcgcggatgctgccggtcgcggacggcagcgatttcggcggttcgctgcgcaatccggccgcgttctgcaacatctacggcttccgcccgtcgcagggccgcgtgccgcgctggccgggcgtcgacgtgttcgtgcagcagctcggcatcgaagggccgatgggccgcacggtcggcgacgtcgcgcagctgctcgcgatccaggccggctacgaccgcaacgatccgctgtcgctcgcggaggatccggccgtgttcgcgcagccgctcgacaccgacctgcgcggcaagcgcatcgcgtgggtcggcgactggaacggctatctcgcgaccgaggccggcgtgctcgcgctgtgcgagcaggggctggcgacgctgcgcgagatcggctgcgacgtcgatgccgcactgccggcgttcgcccccgaccggatctggcgcctgtggctcgcgcaccggcacttgttgtccggcggcgggctgctggcgcactatcgcgacccggcgcggcgcgcgttgctgaagcccgaggcgatctacgaggtcgaagggctgctcgcgatgcagggcgcggccgtgttcgaggcgagcgtcgagcgcaccgcgtggcatcaggccgtgctgagcttcttcgaccgctacgacttcatcgcggcgccgaccgcgcaggtgttcccgttcgacgttgaccagcgctggccgacggagatcgcgggccgtgcgatggatacctaccaccgctggatggaaacggtcgtgccgtggacgctggccggctgcccggtgatcagtgtgccggtcggcttcaacgacgctgggctgccgatggggatgcaactgatcgggcgcccgcgcgccgatctcgccgtgttgcagctcgcgcgcggctacgagcaggcggccggctgggtggacgggcggctgccggcgtggatggcgcggtgatacggcggccgggcgatagccggttgcggagggggccaagcgggcggcggcaagccgctcgttttgcttttgtttccgaacgtgttgccggggcatgtcacgccgagcccgtggcgcgggcgcgttgcgcgacggcatgaagtcatgccaatgacgcggcacggaacgttctgcgtcacgccgcgccgtgctgttcttcggcgcgcgtcacgccggatcccggcacgggcgcatttgcgcgacggtgtggcgtcatgtgattgacgcggtccggcacgttccgcgtcacatgccgccggtcgatgttgaatccgacgtgcggttcaagacgtgcgacggctgcaggccaccggccgcgtcaccgtgcggacgccgacattcgccgccattgatgcggctcgagaacgaatgtcgggacacgcgggatatcgcgtggcatacccggacgaatccgctcgagcgcgtacgccggccgcggaattacaagccttcgcgtctcatgatttcgtttcgatgtgtttcagtcgttgcggcggcgcggcgcgcttcgacaatattggcctcgatcattccggcacgaggaacacacatgaaacacattcgcgcgacgggccggtacctggcctcggcaggcatcgcgttcggcatcctggcaagcggcgccgcgcacgcgcagctcgacctgcagtcgctcggcgcgtcgctgctcggcggcgggcagcagcaggcggcgcccgcgcagggcggcgtttcccaattgctgcaggcttacgtcggcgcgaaccagcaggtgctgaccggccagtcttcgctcgcgtcggcgatgggcctgaccggcgcggccgggcaggcgcagcaggccgcgagccagctggccggcggcgacgcgctgacgccggccgcgctgtcgcagatgggcggcgcgcagcaatcggtgtcgcaggcgctcggccaggcgttcgcgagcggtggcgcgacgcacgggccgatcgacaagcaggcgttcagcaacggcctcgcatcgctcgggcaggggctcacgcagtattcgcagctgcagtcggggctcggcaatctcggctcgacgagcgcggcgtcgctgttgcagtcgggcctgaacccgcagaacatgcaggctgcgtcatatatcgcgcaaagtgcgccgggccagctgcagtcgctcgcggcgacgctcagccaggccgtgcagttcgcgacgagccagggtatttcggtgccgtcagtcgcgtcgtccgcgctgaagctgctgccgtaacgttgcgcggggccgcgcgatgctgtgccggcatcgcgcgacgacgaagatcgccccgcacaacatggggatttcgcgcgatgttatcgtggcgtgtcccttttcggtgcaggttcatgactgactcgttcgacctctcgcgctatttctcccgcatcggctacgacggcccggtcgagccgacgctcgacgtgctgcgccggctgcacctgctgcacccgcaagcgattccgttcgaaaacctcaatccgctgaccggcgcgcgcgtcgcgctcgacctgcccgcgatcgtcgacaaggtgatcgaacgccgccgcggcggctactgcttcgaactcaacaagctgttctacaccgcgctcacgacgatcggctttcgcgtgacgccgatgatcgcgcgcgtgcgctggatgcagccgccggaagtcgccaccgcgcatacgcacatgctgctgcgcatcgatctcgacggcgcggcctggctcgccgacatcggcttcggcagcgccacgctgaccgcgccgctacgtttcgtgccggacgagcggcaactgacgccgcacggcgcgttccgcgtcgtcgccgcgccggtcgacggtgaattcgagatgcagatcgagacgcccgacggctggcagaccacctaccggttccagccgaagcgggtcgaatggatcgactacgacgctgcgaactggtttacttcgacgtatcccgaatcgatcttcctgcacaacctgatcgcatgccgcgtgctgccggacggccgcgctgcgctgcgcaacaccacgctgacgatccgcgatgcggcgggcgccgggcactccgtcacgttcgacgatgcggccgcatgggccgcgtgcctgcgcgacacgatcggcatcgatacgacgggattcgatctcgacgcgctgttcgcgcggctggcggcgcgcgctgcgacgtagcgcgggctcacgatacctgatcgcggctcgcgcaaatgggctgcatccgcacttgatttttactagattgctagcatactagctcccatgaccgacgaagaagtgaagcaattcaacgtgtacctgccgctgagcctgatccggcaggtcaagcatcgcgccatcgaaacggagcagtcgctgtccgcgctggtggccgatgcattgcgcgcgtacctggccgcgccgcagccgggcgcggggccgtccatcgaggaggagtgacatgtcatccgagcgaatcgaagccgtgtacctgacgacgcacaactggggcaagtcggcgaagtttttccaggcgctgggcttcacgctggagttcgaaaccgatcacaactcgggccagctgcgtcatggcgacggcccttcctgttcatcgccgaagtgccgccgggcgaaacgccggacatgcaggtcgtgctcaaggtgccgaatgaacaggcggtgcagccgcagccgatcgtcgacgtcgtcacaccgttcgaggatacgcactggggcacgcgcgacatgaccgtacgcgatccggacggtcgcgtgtggcgcctgcaggcaccagggcagcagggtgcgtgaggccgacatgaccgaaccccgcgaaagcgcccccgacagcaccgccgcgcgcgtcgcgctgtggcgtgcgctgcacgtcgaactcgatgcgccgccgcatgtgctcgccgacgaagtcgggcggcaattgctcgcaccggaacccggctggcagcagcgcggtgacatggatccgcagttcacgcggccgtttcgcgcgtcgatcgtcgcgcgggcgcgcttcatcgaggatctcgtggtggagcaggccgcgcgcggcgtgagccagtacgtgatcctcggcgcagggctcgacagcttcgtgcagcgtcggcccgacatggcgtcgcgtgtgaccgtcttcgaggtcgaccagccggcgccgcagcgctggaagcaacggcgcctcgtcgagctgggcttcggcgtgcccgactggctgcgtttcgtgcctgtcgatttcgaggcgaaacaatcgtggcgcgcggcgctcgtcggtgcgggcttcgatgccggcaagccggcggtcgtcgtgtccaccggcgtcagcatgtacctgacgcttgaggcgaacgcggccgcgttgcgcgaagtcgcctcgctcgcgccgggctcgacgctcgcgatgacgttcctgctgccgctggaacatgcggattcggacgtgcgtccggggctggaaatggccgcgaagggcgcgcgcgcgagcggcacgccgttcatcagcttcttcatgccggcacagatgcaagcgctcgcgcgggaggccggcttcacgaagaccgagcacgtttcggctgccgaactgacgcgccgctatttcgcggatcgtgcggacggactcaggccgccgaacaacgcggaggaactgctggtcgcgacggtctagcctcgcgcgtacgcaagcatgccggcagcgcgccggttccggtcacgcggaaccggccagcctggtcatgcgcgttcgagcacggccatttcccgcacgaccacgagcagcaccgcgaggctcgcgccgccggacgcgcgcaagtcggcgagcaggtgctcgtagcgtgcgagcgcggcttcgcggcgcgcgcgccacgcgccgacgatcgtctccggcgtggtcgaatccggcgattccgcaagcgcgctcgccgcgagcgtgcgcttgaggcgcgcgacttccgcgagcgcggccgcgcgcgccagcatgtcccagtgcgtcggggtcggcagtgtcgccgcgcgctcgccgatccagctgtaattgagcagcatgccgagcgagaaatacacgcccgcgacgagttcgaggctgcggttgctggtcgcggccacttcagcgatgtcgagcagcgcggccgagatgtcgccgctcgcgacgcgcaccgcgagcgcgctgtcgacgccggcttccaccagcacgcgctgccgctcggacagcgcttcgagatcgtcggccggcaacagcgacggcagttgcggcgcaagccgctcggccgcgtcgcggcagcgcgcgatcagctcggcgacgccgccgtcggccaccgcgccggattgcagatgccgcaggaaccacagcgccgcgcgttccagcagccgcgcgacgtcgacgaacatgcgcgcctgcacgtcgtcggcgacgcggttgtcgagcgcatcgatgtcgcgccacaccgcatcgaggtcgaacacgtcgcgcgccatgatgcacgcccgcacgatgtcgccgggcttcgcgtcggtttcctccatcagccggtgcacgaatgcgcagccgacgcggttcacgagcgcgttggtcagatgcgtcgcgaggatctcgcggcgcagcggatggcggcgcatcggttcgctgaagcgctgctgcagcggcttgggaagtagtcgacgagcatcgcggcaaccagcggatcctcgggcacgtcggattcgagcagcgcgtcgtacagccacatcttgctgtacgcgagcagcaccgcgcgttccggcgacgtgaggccgagcttcgcggcttgccgttcggcgacttcgtcgtcggtcggcaggaattcgatcacgcggttcaggcggcccgcgcgttcgagccagcgcatcaggcgcgcctcggcatcgagcagctcgaccgcataacggccggcgatcgacagcgcctgcgtctggtagtagttgtcgcgcagcacgagcagcccgacttcgtcggtcatctccgcgagcagggcgttgcgctgcttcccggtcatctcgccgtcggacacgacgagcccgagcaggatcttgatgttgacttcgtgatccgaacaatcgacgccggccgagttgtcgatcgcgtcggtgttgatgcggccgccgcgctgcgcgaactcgatccggccaaattgcgtgcagccgaggttgccgccttcgccgacgaccttgcagcgcaggtccgcgccgttcacgcgcaccgcgtcgttcgcgcggtcgcccacttgcaggtgggtttcgcgcgccgccttcacgtaggtgccgatgccgccgttgtacagcaggtcgaccggcgcctgcaggatcgcgcggatcagctcggccggcggcagcgcgtgcgcgtcgatgccgagcgcggcctgcacggcgggcgacagcgggatcgtcttcgcggtgcgcggatagacgccgccgcccgccgagatcgcggccggatcgtagtcggcccagctcgagcgttcgagcgcgaacatgcgtgcgcgctccgcgaagctcgtcgcgggatcggggttcgggtcgaggaacacgtgccggtgatcgaacgcggcgacgagccggatatgcggcgacagcagcatcccgttgccgaacacgtcgcccgacatgtcgccgacgccgactaccgtgaagtcggtcgtctgcgtatcgatgcccatctcgcggaagtggcgcttgaccgattcccacgcgccgcgcgcggtgatcgccatcttcttgtggtcgtagccgaccgagccgccggacgcgaacgcgtcgtcgagccagaagccgtattcgtgcgagatcgcgttcgcgtagtcggagaaggtggccgtgcccttgtcggcggcgaccaccaggtacggatcgtcggggtcgtgccgcaccacgtcgggcggcggcacgatcgcgttgccggccaggttgtcggtcaggtcgagcaggccgcgcaggaaggtctggtaacacgcgatgccttcgcgcatccacgcttcgcgatcgctcggcggcggcgggttcttcacgacgaagccgcctttcgagccgaccggcacgatcacgacgttcttcaccatctgcgccttcatcagcccgagcacttcggtgcggaaatcctcgcggcgatccgaccagcgcaggccgccgcgcgcgacgcggccgccgcgcaggtgcacgccctcgacgcgcggcgaatacacccagatctcgaacatcggcttcggttcgggcagcccgggcaccttggccggattgaacttgaacgacaggtacggtttcgattcgccgtttgcgtcgacgaggaagtagttcgtgcgctcggtcgcgttgatcacgccgaggaactgccgcaggatgcggtcttcgtcgaggttcggcacctggtcgagtgcgccttcgatcgccttcagcagccgctcggcctgcacgtcgcgcgtgtcgccggtggccgggtcgaagcgcagcaggaacagctcgacgagctgccgtgcgatcgccgggttgctggtcagcgcgcgctcgatatacgcgtcgctgaaggtcgagccgacttgccgcagatacttcgcatacgcgcgcaggatcgtcacttcgcgcgcactcagatgggcgcgcagcacgaggcggttgaagtcgtcgttctcgatccggccgctccagatctggtcgaacgcatcctcgaacaggcctttcacgcgctcgatgtcgaattcggtgtcgtccgcgagctcgaggccgaagtcgtgcacccacgcatgcgcggcgtcctgtgtctggatccggtacggccgctcctcgtccacgcgcacgccgagatgctcgagcatcggcaggctgcgcgacagcgcgatcgggtcgcccgcgcgatagaccttgaagcggaacgcacgcgcttccgcctcgatcggccggtacaggttcatcgcgagctgccccgaatccttcacccgctcgatcagctcgatgtcgcgcacggccgtgcgcgccggatagtcgtcgcggtagccggccgggaacgaatcggcatagcgctgcagcagccggttgccttgctcttcgccgaaggcgtcgagcagcgcgtcggcgagatcgtcctgccagcggcgcgtgacctgcacgagccgcgtttcgagctcgcgcgtgtcgacgtcgggcatcgtgcccggttccgcatgcacgacgaaatgaatgcgcgcgatcgccgattccgacagcagcggcgtgaattcgacggtcacgccgttgtacgcatcgacgagcagcttcgcgatgcgccggcgcaggtcggtgttgtacttgtcgcgcggcacgaacacgaggcacgacacgaagcggtcgaagcggtcgcgccgcacgaacaggcgcgtgcgctggtgttcctgcagccgcaggatgccaagcgcaatgtcgtagagctggtcttcgtcggcctggaacagttcgtcgcgcggataggtttcgagcaccgtcacgagcgacttgccgagatgccccttcggcaggaagcccgcgcgccgcacgatgttcgcgcacttgcggcgcacgatcgggatctcggtatacgaaccgaaataggaggtcgacgtgtagagcccgatgaagcggcgctcgccggtgaccttgccgtcggcgccgacgagtttcacgccgacgtagtcgagatagccgggccggtgcacggtcgcgcgcgaattcgccttggtcaggaagatcggccaggggccggtgatgatgtcggcggcggcctgcggcagcggcgtgacgtcgggggcgccggacgtgcgcagcgattcgcgcaggatgccgaagccggtgccctcgatgccgcgcagcccgaagcccgtgccgtcggacacgagcgcgtagtcgcgctggccgaggaacgtgaagtgatcggcggccatccattcgaggaacgcgcgcgcctcgatgtcttccgcggtcgattcgcgcgccttcatctccttgatcgtcgcgcgggcgatgtcgacgatcttcggccagtcttccaccgatgcgcgcacgtcgccgagcacgtgcgcgatgtcgttgcgcaaggtgttgagcagcgcggcatcgccgcagcgatcgacttcgaaatggatgaacgacgcgagctgcgactggccgtcgccgggcgtcgcgccgcccgcatcgacgcgctcgatgccgccgtcggcgccgcgccagatgcggaacaccgggtgcagtgccgaatgcagcgcgagcccgaggcggttgacggccatcgtcaccgaatcgacgaggaacggcatgtcgtcgttgacgatctcgatgaccgtgtggtcggaatgccagccgtgctgttcgaggatcgggttgtacacgcgcagccgttcgctgccgggcacgaatttctgggcggtctgccagtgcgccatcgcggcgccgtagagatcggcgatgctgcggctctgcagatcgtcggcatcggcgaaatcgtagtaatgacgcaggaagggttcgacgatccggaacgtggcttcgggcaggcgcccgcgcgcgaattcgacgacgtccgagagcagatgtgcgacgacttcctcgtgcttcgcttccatggcggtctcctcgtcgggtggccatcggctgctgcgtctgagccgcattatatgcaccgatcgcgtgacaatgcgatgtgcgcgcgcacatcgggaggcggagaaggaagccgcctgcagcgccgccgggcgggcgccgcaggtgatgaatcagtgcgatgcaggcgggcgttcaagcatcgccgggtgtgacgttcagcgctcgtcgctccacagcttcccggccgtcgcccagttctccttcttcacgtcggtgaggatgatgtcgaccgagcccggctcgcagccgagcgtctcgcaggtgacgcgcgtgattgcttcgacgaattcgcgcttctgttcgacggtgcggccttcgaagagctggatattgaaagtcggcatgacaagtgctccggttgagtgtgtcgggttctgccgcgatcgcggccagggatgcggcgtcagtcgcgatacgacggatcgatccggtcgagccggcgcagcagcgccggccattccagttcgccttcgatcgcgccgccgtcgcgcagttgttcggcggtgcggtcggccaccgccgggtcgggcagcacgagcggcccgccgccggcctgcgcgcgcacctggatatcgcaggccttgatcagcgtgtccatcagcacataggcttcggcgacggtgcggccgaccgtcagcgtgccgtggttgcgcagcagcatcgcggatttcgcgccgaggctcgcggtcagccgcgcgccttcggccggcgagaacgcgagtgcctcgtagtcgtggtacgcgaggtcgccgtgaaagcgcagcgcgtgctgcgacgcgggcagcagcccgtcgcgctggatcgatacggcgatgccggccgtattgtgcagatgcatcacgcagacggcgtcggcgcgggcggcatgcacggccgcgtgcagcgcgaagcccgtcacgttgaccgcgtgctcgccggcgccgatccggttgccggccaggtcgatcttcacgaggttcgatgcgcggacctcgtcgaacgtcaggccgaacggattgatcaggaagtggccgggctcgccgggcacggtcgcggaaagatgcgtgtagatcaggtcgtcccagccgttcagcgcgacgagccggtaggcggcggcgaggtcgacgcgcagccggtgttcggcgtccgagatcgggccgccgggtttcacggcatcaggacggtgtgcgaatgacgacatcgggttctccgaaggtaaggcggcgcgcgacggctacggtcacccacgatgcaagggcgaaaggcgccgtgaacacggggatgccgacgcgcatcgcgagccactggatcagcgcggcgagtgcggcggctgcaagggccgcgcgcgggccgcgcgacatcagcgccagtgcggcgagcgcgccgttgaagccgagcaggccgtcggcgaacagcgcgccgttcgcgccgagcatgagcagcagcacggtcgacacgatcgcgccgccgagcgcgaacgcggccgcgcggcgcgacgcgacggcgaggcccgcgacgatcagcgcgccggcccatgcgccttgcgcgaaggtggtctgagcaacacccgacagcaatgcgtcggtgacggacgacggcgtcagtgccgcgctggccgtcgcatcggccgcgtgttgcggtgcgacaaacggcagccacagcgcggtgacggcgaggcacgggctcgaatacgggcactggcgccagcgggcgagcggcgtgcgcatcgcgcgctgcacgagcgccgcgccgatcgcggccagcggcgccagcgcgacggctgcaagggaagcgggcgcgaacagcgccgcgatcagcgcggcgagcgcgccgttgaagccgtgcagcccctgttcgacgtcgtggcgcgcggcgcccgtcagcacggcggtcatactggcggcggccgagccgagcagcgccgcgcatgccagccgcaggtcggtcagcgccagcgcggccagcagcagcgcgccggtgagcgcgttcgcctgcagtacgatctgaccgatgccgcgcagcagaatgcgcaggtcgatcgacggcgaggcggagcgggcggtaggcatgatggcggcggaacaggacgagccgcgagcataggacacaatccgatgcaccggaatagggaattctggatagtcaggatttgtcggcgctgccccgaaatggggaatgcgggcggccggccatgtcctggcgggcgttgcgttggcgtttttcggggcgaacgtttcgtggtgaggaattcaggcatccgccggcgttttcgtcggtggattcgtgcgacagtgtcccgcagcgaggaaaccgggaggggaacgatgcgtgaagtgcgatgggcgtcgctcgaaggcgacggggtcgaacatctggcgttcgaccggagcggcggcgggatcgtcgtcgaaagcgcggtggtcggccagcggtacggccgtgcgtacgggctcgcgtatcgcgtcgagtgcgacgcgcactggcgggtgacgtatgcggtgttgaaggtgatgggcggcggcacgctcgaactgcgcggcgacggtgaaggccactggcgcgacggcgcgggccgtgcgctgcccgaactcgacggctgcatcgacatcgacatcgcggcgacgccgttcacgaacgcgctgccgatcggccgcctcgggctcgcgcgcggcgagcggcggccgatcgacgtcgcgtacatctcgacgccggacctgaaggtcacgccggtcaagcaggcttacgcgtgcatcgagccgggccggcgctaccgctacgaaggcatcttccggaatttcaccgccgagatggacatcgacgaagacgggctcgtgatcgactacgagacgctgttcagacgcctgccggcgctgacgggccgctgaaccgcggcgttcgcgacggccggccgctcctgcgcggacgcgaagcggtcgatccgcgacgcgatgatgtcggggtggcgcagcacgacccagtggctgccgtcgatttcctcgcgcacgtggtcgccgagccagcggtcgaggtcgaccgacatttcgggcgtcacgtagcggtcgcgcaccggcacgaggatctgcaccggcgcctgcgcataccgttcgcggggtttgcgcgcccgcgcaaggaagttcgcacggtaaagctgcatgccgttcagcgcattcttcagttgcacgggatcgcgctcggcacgcacgcgttcggtgatctgcaaccagcgcggccagcgccgcgccgccgagccgccacaccagcgacggcacgaccggcaagtggaagaacgcgatgtaccacgacttcaggctctgcttgagccgcatcttcgcgcggaacacgtgatcgaggcatgggcccgagatcgacgtgtacgacgcgatccggccgcggaacgcggggtcggtcacggcctcccagcactggatcgagccccagtcgtggccgacgagatggaacggccggccgccgcaggtcgcgtcggccaccgctttcaggtcgccggcgagccgttcgagcgtgtagtcggcgcggcggcgcggcgcgtctgacgcgccggcgccgcgcacgtcgtacgcgatcacgcggtagcgcttcgcgagccgcgcgcggatcggcgcccacacggccgccgaatcggggtagccgtgcacgagaatcagcggcggtgcgcgacgcgacccgctcacgtagacggcgagtttcacgtcgccggactggacggtcagcatctcgcgggcgcgcgccatggcgtcatgcctgcgcaaccgggtgcagcggcacgcggcgcggggcggcttgcgcggcgtagcgcgcgttggtcgcgtcgatgttctcgagcagtgtgtcgagcccctgcaggtactggtggttgtcgtggtcccacgggtggaagccggggcggaagtagtcgagccattcgcgcgcgatgctcgggaacacgccgtgtttcgggctgtacaggtacttcacgagccgccacatgccgccgaacttgccgtgttcgcgacggtgcgcgcgcatcaggcgcacgtggaagtcgaacacgatcgtccagaagaacacggtcgtcgtcagcatcgtgcccgtgcgcagcaggtagctgccgaggcccggcttcatcacggtggtccatacgtcgtacgacacggccttgtgctcggtttcctccatcgcatgccacatccacatctgctggtagccttcgaccgagccgtcgatccggtgctcgtggcccgacagcaactggttcgcgaggatcgccgtgtagtgctcgagcgcgatcgtgatcgcgagctgcatcgaatgcggcagcaccttcttgaaccagccgaggatcgtccacaggcgcttgtcgagcttgtgcgcgggcaggccggacgactgcaacaggtcgttgtattcgatgtgctcgcgcgtgtgcatcgcctcctggccgatgaagccgagtacctgcttcttcagttcgggatcctcgatccggtcgcgatagttgcgcaccgaatccatgaagaagcgttcgccggccgggaacagcagcgacagcgcgttcatgaagtgcgtgaccggcacgccctgcacgtgccagtccttcgcgcgttccggcggcagcgcgaaacggatgtcgcgccgcaccggcatcatgttcggggtcgtcatgattgttctcctcctgattgcctgcgttgttgtaggtggcatgcagcggcgcgggcgccggcgtgccgcgggcggcgtcacggcgcgcgcgggcggcctcgcggcgcgtcgcgaacacgacgagcgcctggtacgcggacggcagcacacgcgccatccagtcgccggccttcgcgtcgcggccgatcagcacgcggcgcttgttcttgcgcacgcccgcgaggatcgtgcgcgcggcatcgtcggcggtcgtgatgaagaacttctcgaacgtgtcgcggccttgctgctcgctcgcgaccatgaagccgaccatgttcttcgacacgcggctcgcctgcgcgatgttcgtgcggatgccgcccggatgcacgcaggtcgctgatacgccgcacttcatcatgtcgagttcctggcgcagcgattcggtgaagccgcgtaccgcgaacttggtcgcgttgtagccgctcatgcccggttgcgcgaagatcccgaacaggctcgacgtgttgatcacgtggccgtcgcccgatgccttcaggtacggcaggaatgccttcgtgccgtgcacgacgccccagaaattgatgttcacgatccactcgagatcgttgtagtccatccctcgatcgtgctcgacagcgcaacgcccgcgttgttgaagatcaggttgaccttgccgtgttctttcgcggtgtcgtcggcccacgcgaacatcgcatcgcgctcgccgacgtcgagcacgcgcgtcgagacacgcacgttcggcgcgatcgtacggacgatccgttcggtttcggcgaggcccacgccgttcttgtcggcgagcgacacgtggcaacctgcctgtgcgagctggatcgcgagcgagcggcccatgcccgagccggcacccgtgatcgcggcgaccttgttggcgaaatctctcatgtcggttgctccttgtctggctcaggccgcttcggtggaagtcgaagtcgaagtcgaagtcgaagtcgaagtcgaagtcgaagtcgaagcagcagcggccggcgcggcggcgggccgcgccgtggtgtcgagttgcggcgcgcgatacgcgtggtaatcggcgatcgagaagtgcgcggtcgcctggcggaagcgccacgtgaagcccggccacagcgtggtgttcttgccggtgcgcggatcgaggtaccagctcttgcagccgcccgtcgaccagatcgcctttttcagcttgccctgcaggtcgctgttgaattgcgcctcgacgagcggacgcacctcgatcgcatccgcgcgttcgcgacgcatcgcctgcaatgcgccgaggatgtactcgatctgcgactcgatcatgaacaccatcgagttgtggccgaggcccgtgttcgggccgacgatcatgaagaagttcgggtagccgggcagcgtcgagccgagatacgcgtgcgcgccgtcgcgccatgcgtcgacgatgtcgagcccgccgcggccgatgatcgcgccgcgcggaaacggatcggccacctggaagccggtgccgtagatcaggcagtcgacttcatggcggcggccgtcggtcgtcacgaccgcgtcggcttcgatgtggtcgatgccggtcgtgatcacgtcgacgttcttgcgcgacagcgccgggtagtagtcgttcgagatcagcacgcgcttgcagccgagcgtgtagttcggcgtgacggtcttgcgcagctccggatcgggaatctgcttgcggatgtggcgcagcgcgagcttctgcacgttcttcatcagcgacggatggatcgcgaagccgagcacgcgcgattcgagcatccagtagatgccgctgcgcacggccttctgcgtgaacggcagcgtacggaacagccacttctcgaacccggtcaggttgcggtcgggcttcggcatgatccacggcggcgtgcgctggaacagcgcgagtgttttcacgcgcggcgcgatctgcggcacgaactggatggcgctcgcgccggtgccgatcaccgcgacgcgcttgccttcgagtgcatagtcgtgatcccagtgctgcgagtggaacgcgcggcccttgaaattctcgacgccgggaatcgacggcagcgcggcgcgcgacaggccgcccatcccggacaccagcacacgtgccgacagccgcttgccgttcgcgaacgtgaggcgccagcgttgcgcggcgtcgtcgtattcggcgcgctgcagttcgtggttcaggcgcaggtgcgcgccgatcccgaagcgctgcacgcagtcttccagatatgcgcggatctccggctgcggcgcgaacatgcgcgtccagcgcgggttcggcgcgaacgagaacgaatagacgtgcgattgcacgtcgcatgcacacccgggtaatgattgtcgcgccacgtgccgccgaccgacgcggccttctcgaggacgacgaagtcggtcacgcctgtttgccgcaggcggatcgccatcccgaggccggcgaagccggtgccgatgatggcgatgtcgatggtttcgtccaggccgtcgtggccgggcggaccgaaaggcagcgtacgagcattcatccggttgtctccgatttggctcattttcgaatgttacattgtttgatgtaacgatagtgggtgaacccggaaaccgcaagaggctagaagcggcgctctaagggccggaagccaggctggaaaaggctgagcggggtttggaacgggccggtttccgcatcgcggaatgcgcggaaagggccgtcggcagggcaagagagggagcgcacgagaccgccggcgtgcggcggtctgtttgaaacggtatcagggacggatcgttcgggcggccgtctcatggaaaaccccggccacgatcgtgacctgcgcgagcgcgtagaggccccagatcaggtactcgatgcccggaaagccgccgaggaaacggccgacgccgatcagcgtatcggagccgacgaagatcaggctgccgacggccaccagcgggccgcgcgtgcgggccgcgagcgcgaagctcgccatcacgcagagcacgagcatgtagacggcgacgggtgcgagcagttcgccgaggtgcgggaagaacgccacgtagaacgccggggcggcgatccacagcccgacgagcgcgacgacgcgccagccgtgcggccgtgcgcgccagcgcatgaagatcgcgcaatagcacaggtgcgtgagcaggaacgcgccgaggccgaggacgaacgacagcggccagtcgggcagcgcgagcagcacgtcgccgagcacggcggtcacgagcgccgcacacagccacgcgcgttcgcgcgccgcgccgcaggtgctgcccgccgcgagcagcaggatgcccatcgcggctttcgcggcggcctggccgggatagggggcggcagcgagcgacagcccgtacagcagcgcggcgacgacggcgagcggccagagccggcggtaggtggcgggaagcgtggcgatcaaggcgggtgtctccggtttgttgttgtctgcggtggacggcgcacggtcgaggcgcggctgccggccattatccggaagaaagggcgcgggaaaaccggcgaatccttctaggacgcggcaggcaggggacgcaaaggcgcctggccgcaaccgtggcgatcgggcgttgccgtgtgcacgacgggcgaacgccttcacccggtttcttcgacgtgttgccccggtcgagccggggcaacgacatcaattcggcttgttatgatcgccgcggtattgccgttgtcgttgttccgcccggccgcgtgacaggatgcgcaagccggtgcgtgcccgatgaatccatgccgtgcccgctccgcgcgccgatgcaacgcggcgcgggccggccccacgaaaaatggtccgaccatgaccgaacttctccatggcgacggcgcgatccgtcgcacgacgccgtacggctcgtcgatcgaaaacacctatgcgggcgtgctgtcgttcatgcgccgcaactattcgcgcacgctcgacggggtcgacgtcgcgatctccggcgtgccgctcgacctcgcgacgacctatcgctccggcgcgcggctcggcccggccgcgattcgcgcggcgagcgtgcaactcgcggagcttcacccgtatccgtggggtttcaacccgttcgacgatctcgcggccgtcgactacggcgactgctggttcgacgcgcacaacccgctgtcgatcaagcccgcgatcgtcgagcatgcgcgcacgatcctgcgctcgggcgcgaagatgctgacgctcggcggcgaccactacatcacgtatccgctgctggtcgcgcacgcggagcgctacggcaagccgctgtcgctgatccatttcgacgcgcactgcgatacgtgggccgacgacgatccggacagcctcaatcacgggacgatgttctacaaggccgtgaaggaagggctgatcgatcccgcgacgtcggtgcaggtcggcatccgcacgtggaacgacgatttcctcgggatcgagcggctcgatgccgcgtgggtgcacgaccacggtgcgcgcgcggcggtcgagcggatcgtcgacatcgtcggcgcgcggcccgcgtacctgacgttcgacatcgattgcctcgatccggcgttcgcgccaggcaccggcacgccggtcgcgggcgggctgtcgtcggcacaggccctcgcgatcgtgcgcgcgctcggcgcgatcgacctggtcggtgcggatgtggtcgaggtggcacctgcgtacgaccacgcggacatcacggcgatcgcggccgcgcatgttgcgtgtgacttgctgtgtctgtggcggcagaagaaggtggcgggggcgctgaagtaagcaggcatgccgggtatgcgcgtgccgacggcgcgcgcacgttgtcggctcggctgggctgggctcggctcggctcgatgcgaggtgtgccgattgccgtctgcatccggtggattcggcgaccggccatcggggatttccgtggaaggtccttgccgccccgtcggcgacatccgcgaaacgtcagcgagcggctgctttcgtacgccggcgaggcattcgagtgtcaccgatgatgcgtgacggcgtcatcgagcgaaaagctatcgattcctgaagaaagcggaaagcatgtcgtctaccggagcagcatggtacggcgtcgctcgctgctttcccgatcgtccgcgggatcgcgcgcgatccggctcgacatcggtgccaaccggccatgttcctgtataaaccgcacgcggccggatgagatcggattgcgcgcgctgctcgagcccgtgcgcgatccagccgatcgagcggcccagtgcgaacaggccgaatgcggcaccgacgggaagccgcaaatgtctgcgcagtgccaccagcgcgagatccacggagggcttctggccggtgagcgcgctcctgcatcgagcatcctgttccactgagggtggcgcggcaggattcgcgacaacagatacgtcgcgcgcacgtcgccgtcggggtagagcgaatgtccgaagcccggcaagccgtcaccccgggcgagacgctcgctcattttccgttcgacatccttattgccgatttcgtcccacagtgcttcgccgcgcgccgtggtggcgccgtggcgttctcccgacaggccggccaggccgccgaccacgacggcccgcaggctcgcgttcgtcgacgcaatgcaccggcccgtgaagctcgacgcgttcagttcgtgatccgcgcacagcacgagcgccgccctgatcagctcggcgcccgcgggcccgacgccccacgcccgcgcgcattgcacgtggacgggggccgtatcgatccgggtgcgcagcaggcatgccgccagaatccgcacgagatcgccgcagccctgtgcgtgacgatcggacgattgctgccagatcgccgtcggcgcgtcctcgctcgcgacggtgaagagcggcaacagtgcctgctcggcacgttggtcgccgtagtgcctgaagagcgttcgcagcaccgcgggcgtagcgggggcctggcggccgaaagcggtctgctcgtcgtttcgccatagcagcgccgcgacttcctcgaggctcgcacggctcgcgagatcgagcgcatccgtaccgcgatagaagagccggccgccgtcgatcaacgtgatgctcgattcgagcaccggggcaccccagttcagcgcggcctttgccacttccttcggcttgcggcctcgtgcgcgttgatccgcgagccggtcgacgtcggccgcgaggtagcggctttcacggtggctgccgccaggttccgcgcgaagcaggccgcggctgacgtacgcatagagcgtttgccgcgagacgccgagccttgccgcggcgtcggtcgaattcaggtagttcgacatcgtgcgcagagtgaatcgttcgacaggttgatcaggataatcaacgttgacagcaaatgcgagcgagacgatctttgcgtcacctaattcatgcgaggcgaacatgcgtgtcgatcaaatatcgcgggaacgggccacgaccgacgaggatcgggtgtcgcgccatctgcggacgttctggctggcggccggcggctctccggcgttcctcgaatcgtgcagcttcagcggcgccggagaactggtctccgcgtttcgcgtaaccgacatggccgcggcggcaatcggggcggcggggacgtccgtcgccgaattgctgcatgcgtcggcaggaacgttgccggcggtacaggtcgaccggcgcatggcgtcgctgtggttcggcacgtcgctgcgtccgcagggctggacgatgccgcctcaatgggatccggtggccggcaactatcgggcgcgcgatcgctggatcaggttgcacaccaacgcgccgcatcatcgactggccgcgttgtcggtactcggctgtgccgccgatgcggaatcggtcgcgcaggcggtgagtcgctgggatgccggtgcgctcgaggcggcgatcgtcgagcgtggcgggtgtgccgcggcgatgtactcggcgcaggagtgggccgggcatccgcaggggcaggcggtcgcagccgaaccgttgctgcacgttcatttcgcgacggatgccgtcgcgcatgcctggcggccttcgagcgaccggccgttgcgcggcattcgcgtgctcgacctgacgcgcattctcgccggccccgtggcgacacgatttctcgccggcctgggggccgaggtgctgcgcatcgatccgtacggctgggaagaaccgggtacggtgcccgaagtcgtcctcggcaagcgctgtgcgcggctgaacctgaaggatgccgcggatctcgatacgctcaggcagttgctgcgccgcgcggatatcgtcgtgcacggttaccggtcggatgcgctggcgcgcctcgggctcgatgccgcgcaacggcgcgaactgaatcctgcgctcatcgacgtgtcgctcgacgcgtatggctggaccggcgcgtggcgttgccggcgcggcttcgacagcctcattcagatgagcacgggaatcgccgaggcgggcatgcgcgtgacgggcagcgatgaaccggtgaacctgccggtccaggcgatcgaccatgcgacgggctacctgatggcgacggccgccatccgcgggctgaccacgcgaatgacgcagggtgtcggtaccgaggtccgcgcctcgctggcgcgcacggcagcggtcttgcagttgcgcccggagccgatgagcgaggtggtcgaactggtagccgacgatcagcgggatcgggcggaccacgtcgagctcacatcgtggggccggcatcgcggcttcgcccgccattgcagatcgacgatgcgccgctgcgttggttttatccggcacgtgcactgggtgcatatgaacccgggtggttgtcttcgagcgacgatctttgagtaagcgcgtttcccggtcttcggcgccgtacgcccggaaggtcaacgtgacgcgaagaagtcgggggcgatgaacggccggacggttgccgacaccatcggccggcacgtgaccacgtagagcaaccaggtcaatggaggcgcgaagcgggcagttgctcgccgcccagattccgcaacgtcgggcaatgcagaaaaggccggtgggcagcatgcccgtcggccttttcctatggacgtgtgcgaagcgtgggttcgcgctacttcgcggcgagcgcggatgcgatgctcttgtcgctccacgcgttgtcggctacgctcaacttctgcggaatcagcttcgccgcgtagaacgcatcggcgactccttgctgggccgcgacgatccggtcgtcgatcggcaccgcgccaaacgggacacgcttgatccacgtctcgacgagcggttgcggcaggccgaccttcggcgcgatcagcgcggcggtgtcggccggatgcgcgttgacccacaggcccgtctcgcgcgcctgcttcaggatcgcgccgaccacgtcgggatgctgctgcgcgaagtcccgcgtcgcttcatagaagttgttggtcgccgcgaggcccgtgtagtcggacagcgtgcgtaccttcagcgtgttttgcgcggccgcgtagtacggatcccagacgacccacgcatcgacgttgccgctttcgaacgcggcgcgcgcgtcggccggcgcaaggtacacggggtggatttcgtcgtagcgcacgccggccttctgcaaggcttcgagcagcaggtagttcgcgctcgagcccttctgcagcgcgattttcttgccgcgcaggcccgtaaccgaacggatcggcgaatcggccttcacgagcacggcttcgttgtgcggcgccggcggttccgcgccgacgtagacgaagtgcacgccggccgcctgcgcgaacacgggcggcggcgcgcccgtatagccgaagtcgatgctgttcgcgttcagtgcttcgagcagttgcggcccggccgggaattcgaaccactggacgccataaccgagcggcttgagccgcgcttcgagcgaaccttgggccttgacgaccgacagcaggccggccttctggtagccgatgcgcacgaccttgtcggcactaccttgcgcgaacgccgatgccgcggacagcgtgacgagcgtgacggcggcggtgcgggcgatccagcgggtgaaacgaatcatcgaacggactccatgcaaaacgtcttcgggcgagcggcggtgccgctcggttggaagaatcgtcgcatgggcggtcgcgcccgcaaacgaagcattgccgatatgaatatgacggcggcgcgcctatgcttcgtcgtcgtgttccgatgccggcgtgccggactgccgtgcggcctcgtcgctgagcttttgtcgaggatcgtcgcgacgcggccgccgagataggcgctcgcggcggtttccagcgcgcggttcgtctcgccttcgacgaacacggccgcgagcgggcgcaggcgccagatcgcgtcgaccagctcgggcacgtcggtggcgggcggcagcgtgccggcgtcgtagcggtcgagccgcttcacgacgagatcgacgagcagccgcgcgatcgcgtcgaaatgcggccgcgcgaggctgatcacgtcgagcagttcgcgcggcgggatgccttccttcgtcatggcggccgccgcttcgagcagcgcggggctcttcgcgacgaacgacaggccgcgccgttcgagcaggccgagttcggtgacgcgtgacagctgcgtggtcgcctgcgggccgaacatctgcgcgagcgcggcgagcgaataggttttcggcagttcgtgcgaccagcggccgccgatcgcgttttcgaggccgaggatcgagcgcaggtcgtggccttcgtcgatcgccttgatcaggtcctggatgttcgacagcgtgtagccgcgcgcaggtggttgatcagcttcaggcgcgcgacgtgcgtgtcgtcgtaaatgccgacgcggccgcgcttttccggcggcgcgagcaagccgcgatcctggtacgcgcggacattgcgcacggtcgtgtcggacacgcgcgcaagctcgtcgaccgtgtactcgttgcgggagtccggcgcggcctcgtcgggtgtggaatgagtctgttttgacatgcggccattctagcgcgacgtggcgcgccagggtccgttcgcgcgcacgaagggccggcgcgagtcggtcattcgcatgaccggacctatggcgagacggggagcgtgcgcgcgccgtcgccgagcgggcgctgcagcagcgccgtatcgatccagcggccgtgcttgaaaccagccgccttcagcatgccggccggctcgaagccgaacgcgcgatgcagcgacgtcgagccgccggtgccgccatcggcgatcaccgcgatcatctgccgccacgggccggcctcgcagcgttcgatcagcgccgcgagcagcgcgcggccgatcccgcgcccgcgctgcgcatcgtcgatgtagatcgaatcctcgatcgtgaagcggtacgcgctgcgcgtgcggtaaggcgtcgcgtacgcgtagccggccacgcggccgtcgcattcggcgacgaggtacggcagcccgtggcccaggaccgcgtcgcggcgcgcgcgcagttcggcgacgtcgggcggcgtttcctcgaaggaggcgacgctgtggtgcacgtggtgcgcatagattgcttggatcgcgtcgagatcggcttcggtcgcgtcgcggacgacgcaggcggctggcgagatggacatggcgacggagcgacagggtggggtacgggaaaaccactactatgcgggcgattgcccggcgcgtaaagcggtggccgcggcgatggcgagcggcggcgacaacggcggtagccgcgcgtccggcgccgcgggttcagttcggcggccgcttcttctgcgtgtcgcgcggcaactcatcgaagcgggcgaagtagtaggcggaaaagcggccgaggtgcccgaagccgaacgtcagcgccgtatcggtgatgctggcagccgggtcggtcagcaactgcacgcgcgcggcgtccagccggatgttgcgcagcagctccatcggggtcgcgccgtgatagcggcgacacagcacgttcagcgtccgcaggctgacaccggccgcgcgggcgagatcctcgagcgagatcggcgcgcagagccgcgcgtggatgaattcgtgcagcgcatccatctgccggatgtcgccgcgcgatccggcttgcgcgggtgcgccgcgcgcttgcagcgccgggccggcttgcacggcggcgggcgacggcgggcaatgcacgagcaggaacagcgcgaggctttgttcgaagtggtcgcgccattcggcccgtatgccgccgtcgtcggcaacggcgagcacgttgagcagcgactgtgcgatcagatcccactgcgacgcaagcgccgtcggcaacaggaagcccggcgcgaggccgggcgccgcgtcgtcgggccggcggccgcagactgcgcgcatcagcgaatcgggcaccttgacgatcagctgccgggtgccggttcgccagcgcaggcgcacgcgcgacgtcggtgccagcacggcggtacgcccttcggacacgcccatcacgtgcccgtcgcactcgatttcggcgccgcccgcgagggacgtgtggacgagcgaaaagccgtcgaacgggcgcggggcgacttcgacttcggcgccgtactgcagcgcgtagacgctcaggtgattcagttgccccttgaacagcgctgcgtcgggtacgccctgcttccagcgcagtgcatgctcggccagttccagcgagacctgctcgtgcgcatccgtgcgcaggccggatcggaacacgcaattccgatacagcgcggacaatgcgtccgcattcggggtgagggcatggggcgtctcctgcgtggcgtttttcgtgcagcacatcggctggccgcggatgtgcgtcgtgccacatcggtttctcttgtgagcgagatatcctgaaacgatgatattgatctttgtcaggcttgtcgaaagtttcgcaagaatcggatagtcccgtccccgccggggagaaatccggatagcgcgcggcgtgcggcacgagaaaaacgaaccggattcgcgagcggcctgcaaattccggatagtggaaatcattgtggcttcctacactgcgccggcagccggacgaacagcggcgcatttcatgtcaatgattcgtacaactactaagttgatgggccgaccgatcgtactaggtcgaattcgcgtaatgcgacggctaccgccgggcccgggtcccctctggaaaaggaaggaagctccatgcgtcaaatcaacctgcaggcgctctcggacgatgcgcggctgggcaagctgcacggcgtcgtgctgttctggtgcgcgctgatcatcgtgttcgacggttacgacctggcagtggccggcatcgcgctgccggcgatcatgaacgagatgggcgtcaaccccgcgcaggccggcttcatggtcagttcggcgctgttcggcatgatggtcggcaacatcgtgttcgggaccgtcgccgagcggatcgggcgccgccgggccatcgcggcctgcctgacgttgttcagcgtattcaccgcggcggccgggctggcgccgacgcccgtgctgttcggtgtcgcgcgtttcctcgccggcatcggcatcggcggcgtcatgccgaacgtgatcgcccacatgaccgaatacgcgcctcgccgcgtgcgcaatacgctggtgacgctgatgttcagcggctattccgtcggcggcatgctggccgcggtcatgggcaagggatgatcgacgcccatggatggcaatccgtgttcgtcgccgcgggcgcgccggtgctgctcgttccgctgctcatgaaatggatgccggaatcgctgccgttcctgatccggcacggcaggacggacgaactcgcacgcatcgcgcagcggctcgatcccgcctatcggccgcaaccgggcgactgctatgtcgttccgcgtgccgaccacacgggcaacgcgccggtccggcagctgttcgacgacggccgcgggttcagcacggtcatgttctggatcgcgtgcttcatgtgcctgttcatggtgtacgcgctcagttcgtggttgacgcggctgatggcgggcgccggctacagcctcggctcggcgttgacgttcgtgctggtgctgaacgccggcgcgatggccggcgcgatcggcggaggctggctggccgatcgcctgccgatcaagacggtgctcgtttcgatgtacctccttgccgccgtgtcgatcacgctgctcggctacccgatgccgaccgcgctgctgttcgtgctggtcggcctcgcgggtgcgtcgacgatcggcacgcagatcgtcaactgcgcgtacgcggggcagttctacccgatggcgatccgttcgaccggcatcggctggacgttgggtgtgggccgcagcggcgcgatcctggcgccgatcgtcatcggcgtgctggtgggcatcgatttgccgctggcacagaacttcatggcgatcgggctgcccgcgctggtggcggccgtcgcggtcggcttgatcgatcagcggcgctcggcgtcgcgccacggcctggcggcttcggccgccgaacggcacgtgtcgtccgccgggcagtcctgaacggtttatccgcggcgccggcgcgcggccgccggccgatcgcgcacggcgacgccgcggcccgcatcctgtgaaggggacagtcagtcatgcatctcgattcaagagcgtcgaaggcgatgctggggtggagtgtgttcgcgtcgtcgctgaccgcgacggcgggcaccgtacaggcgcagggcagtgtgacgctgtacggcatcgtcgacaccggcatttcgtactacaaccatgcggcgcagggcggatcggcggtaggcatgccgcatctgaccggcgaattgccgtcgcggtggggcgtgaagggtatcgaagacctgggggcggcaaccgggcgtttttcgtgctggaaaacggctttcagccaggcaccggtcggctcaactacggcgggcgactgttcggccggcaggcgaacgtgggactgagcagcgcatacggaacgctcacgctcggcaggcaaatgaacatgacggcccatgcgctggccaacgccgacgtgatcgggccgtccgttcattcgccgagcaacttcgacgcctatctgccgaatgcgcgcagcgacaacgcgatcggttacctgggcaagttccgcgggctcacgatcggcggcacctacagcttcggccgcgatgccgccgggccagccgggccttccgcgaccggctgcgcggggcaggtgccgggccatccgctcgcgtgccggcaatatacggcgctggtcgcttacgacgcggcgcgctttggcgtcgcggtgtcctacgacgtgaagcgcggcggggcgggcgcatcggcgccgctcgacagcagcgcccatacgagcacgcacggcgtcgtcggcggctacgcggtgatggggcgcgcgaaactcggtgcgggatggatcaggaacaacgtcgcggcggccggccatttgcagaccgatatcgtcttcgcgggcgttgcctatgcgctgacgcctgcggtcacgttcgatgcacaaggcacgcgttatctgcaacgcgggcccgcgagcaacgcgaacgcgacgttgctggccgggcgcgccaaccatcagctgtccaagcggacgcgcgtctatacgtcggtcggctacatgctgaacagcgcgagcgcaggcaaggcggtcgccgccggcggcacggtcgaaacggggcagagccaactggggatcatggccgggctacagcagcggttctgacgaggccggggcgtcagagccgcccatccgccgcgcgaaccgcttcggcgatcgcatccgcgacacgctgtacgcgcggcgagcggcgcacgtccgggtggacgacgagccagatttcgcgctcgatatcgcaacgcggcgcggcggtcagttcgacgagcggcgcaccggcttgcgcggccggatcgtcgacgagaaagcgcggcagcagcgcgacgccggcgcccgccgcgcacgcgcgatgctgcgcggcgaggtcgttcgcgatgaacgcgaaacggcgcccggccgcgaaacgctcgagccactgctgctgcggcgtttgcgcgagcgcatcgtcgtagccgacgaacggccaggtgtcgggcggcgcgctcgcccattccggcgacgcgcacagcgcgaagcgcatcgtgccgagccgccgcgccgcgagccccggctcggtcggccgcgacagccgcaccgcgagatcggcttcgcgcgcgtacaggttcgccgcgtgcatctcgcccatcaggtcgatccgcagcgccggccatgcgtgctgcgcgcgggccaggcgcggcgcgaggaaatggctggcgaacaccggcgacgccgatacgcgtaccacgccgtcgagtgcagccgcacctgggcggcgcgcgcgaacgcatgcgcgtccgcttcgaggcgtgcggcgtgctcggcaaggtgcagcccttcgtcggtgggcggccagccgcgcggcagccggtcgaacagccggatgccgagcgcggactccagcgcgtcgatgcggcgcgcgaccgtcgaatgctgaacctgcagcgtccgcgcggccgccgacaggctgccgccgcgcatcaccgcgaggaagtaccggatgtcgtcccagctcatcggcggcgcggccgcgggtgtggatgcttgatcggtcgaattttgcacagtagatgggcgatcaacgggaattccgatcgattatgcacgatgggatgatcgtgtcacttcattcgattgcgaggaacgtcatgacccaaaccacgaccgccatccggatcgggatcgaccgctacggcgacgccggcgtgctgcgccgcgtcgatgcacccgtcgcgccgcccgatgccggcgaggtacggattcgccagaccgcgatcggcgtgaatttcgtcgacatctatttcaggacgggcgcgcatgcgttgcccgcgctgccggacgcgctcggcgtcgaggcggccggtgtgatcgatgcggtcgggccgggcgtgacggatctcgtccccggccagcgcgtcgcgtatgcgggcatgccgaccggcagctatgcgagcctgcgcacgatgccggccgagcgcgtggtgccgatccccgacggcttgagcgatgacgcagcggccgccgggctgctgaaagggatcaccgtctacatgctgatgcatcgcgtccggcaggtcggcgcgggcgacacggtgctcgtgcatgccgccgccggcggtgtcggactgctggcgacgcaatgggcgcgtgcgctcggcgcgcgggtgatcggcacggtcgggtcggccgcgaaggccgcgctcgtgcgcacgcatggcgccgaggcggtcgtcgattatcgcgaggaggatttcgtcgcggcggcgcgcgcgttcggcggcggcaccggggtcgattacgcgatcgacgggatcggcggcgacgtgctgacgcgcacgctcggtgcagtccgtccgttcgggatggtcgcgagcatcgggcaggtggccgcgatcggcgcacggcacacgttcgatctcgacgaactggggccggcgcgctcgatcgcgctggcgcggccgagcgtgctcggcttcatcgcgcgcgacgtcgacggttaccgggaggctgcgcgcgcgacactcgaacggctggcgagcgggatgcacgtggagatcggcgcgcggctgccgctcgaacaggcggccgatgcgcaccggctgctggagtcgcgcgcgacgacgggcggggtcgtgctggtgccgtaacggcgggtggcggcgaatcgcgaggcggcccggcggctgcatcgcggttcgccagcaagtcagttgtgcttgcgcaacggcgcatccttgacgaaccacgcgagcacgaacgcgatcgcgatgaccgtcgccgccgcgagatagacgacgtgcagcgaaccggcgaacgcatgcaggtacgcgtcgcgcacggcatccggcaactgctgcacggcggccgggccgagcgcaggcggcagctccgtgccggccggcagcgcagccgtcacccgcgactgcagcccgtgcgagaacagcgcgccgaacgccgcgacgccgagcgagccgccgatcgagcggaacagcgtcgcccccgacgtcgcgacgcccatgtgccggaattcgaccgtgttctgcacggcgagcgtgagcacgggcatcaccatgccgagcccgatcccgagcagcgccatgtacgcatacatcgtgtgcagcggcgtatcgagcgtcagtgtggacagcagcgccatcgcgacgccgccggtcagcgtgcccaggatcggaaacatccggtacgagccgagccgcgagatcaatcggccgctgacgaccgatgtcacgagcatcccgcccatcatcggcaacaactgcatcccggcctgcgacggtgtcgaacccttcacgacctgcaggtaaagcggaatgaacgtgaccgagccgaacagcgcgatgccgacgacgaagccgatcaggctgaccagcacgaaggtgcgatggcggaacagttcgagcggcatgatcggctcggccgcgagccgttcttcataaatgaagccgccgatcgcgacgacgccgagcgcgagcgtcatccacagctgcggcgacgtccacggcagcagcgagccgccttcgctcgtgaacaggatcacgcaggtgagggcagtggcgaggaacgcggcgcccatgtagtcgatccggtgcttcacgtgcgcggtgtgcggccggaacgcgacgccgatcaccgcgagcgcgagaaagccgagcggcaggttgatcgtgaagatccagcgccacgacaggtgctcgaccaggaagccgccgagcagcggaccgacgatcgtcgcgaggccgtacacgccgccgaacatcccctgatagcgtgcgcggcggtcgggcggcaccagatcgccgatcgcggccatcgtcacgaccatcaggccgccgccgccgagcccctgcagcgcacgcagcacgatcaactgcgtcatgtcctgcgcgacgccgcacagcgcggagccggcgaggaacagcacgatcgcggcctgcagcacgatcttgcggccgtacaggtcgccgagcttgccgtacaacggcagcacgacggtggacgacagcaggtacgcggtaacgacccacgacaactggtcgagcccgccgagctcgccgacgatcgtcggcagcgcggtcgacacgatcgtctggtcgagcgcggacagcagcatgacgagcagcagcgcggcgacgatcagcccggtcggcgcgtcgcggcgggccgtttcggcggccggcggagtgaggagggtgtcggtagtcatcgatatatctgccatggcagggaattggctcgaactatagcgatggatagttgaccagtcaatttctgcccgggctcgatttgttgcaacggtaacagtagattgccgacgattgccgacgcgaaaaattgaccgggatcagccggaaagcggggctggactcaagtttttgcaggcaaaccgtaatacagcgtgctgcggaccgatttccgcggcacttttcaccgctcacgtcccgtcatgaacctgaacgccctgttttcccgtttctcgatccgcacgcggatcttctccacgctcggccttgtcgccgcgctgctcgtcgtgtcggggctgatcggcctcgccggcatgcagagctcgaaccgcgcgctcgacgaggcttatacgcagcagctggcggcgaaaaccgcgctgtcgacggccagtctcaacctgacgatcgtgcgcacgacgctcgaccgcgcgctgctgcacccggaagcgccggacgtgcccgatctcgtcaagaaggccgagagttatctcgcgaaggccgacaccgcgtggcgcggttacgcgtcgatgccgcacgacggcgacgaaggcccgctcgcgagccgcctcgatgccgcgcgccaggcgctgatcgggcaggcgctgaggccgatgatcgacgcggtccgcgacggccgccgcgacgaggccgaccggctgctgatgtcggtcgcgccgccgctgtcggttgcgctcacgcaggcgaccgatgcgctcgatgcgtaccagggcgcacgcggcaaggaggtgtacgacaccgcgcagacctactacggctggatgcgtgcgggcgcgatcgcgggtatcgcgttcggcctggccgcgtgcctcggctgcgcgatcggcctgcattacgcgatcacgcagccggtgaaccgcctgctgtcgcatttccgccgcctgtcggaaggcgacctgacgtcggaagtgcgctggtcgtcgcgcgacgagatggccgaactggtcaacggcgtgaccggcatgcagcgcagcctcgcggacaccgtgcgccaggtcagccagggttccgaggcgatttcgacggcgacgcaccagatcgcggccggcaacaccgacctgtcgcagcgtaccgaggaacaggcgtccgcattgcaggagacggccgcgagcatggagcagctcaccgcgaccgtgaagcagaacgcggacaacgcggtggaggcgcaggcctgcgcggacaccgcgagcgagatcgccacgcgcggcgcgaccgtggtcggcgaggtgatcggcacgatgaacgagatcgaccagagctcgcagaaggtcgccgacatcatcggcacgatcgagggatcgcgttccagaccaacatcctcgcgctgaatgcggcggtcgaagccgcgcgtgccggcgagcagggccgcggcttcgcggtggtcgcgggcgaggtgcgcacgcttgcgcaacgctcggcgtcggcggcgaaggaaatccgcacgctgatcggcgagtcggtcgagcgcgtcgcgaacggctcgcggctcgtcggcgtggccggcacgacgatgcaggacatccagcaggcgatcggccgcgtgacgggcatcatgacggagatcgcggccgcgtcgaacgagcagcgcgacgggatcgagcaggtgaaccgcgcggtgtcgcagatggaccaggtctcgcagcagaacgcggcgctcgtcgagcaggctgcggctgcggcggcttcgctggaggaacaggcggacgggttgcggcgcgcggtgggggcgttccgggtggcttgagcgacggtgggcggcgacacgacgggcgcttgcccgccgtcgcctgccgattacgtcacggtcgtgagctgcgcggccgcacgcgacgacgcgacgatcagcagtttcatcgtcgcgcgcgtcgcaccgacgaacagcttgcgcgcggcacgcgcgtcgagcgtgtcgaagtcgacctcggtgaggatcacgcagggcgccgactggcccttgaagcggtagatcgaatcgagcagcacgtcgccttcgcgatattccgggttgccgaacaggtcgtacttgccggtgaagctcttgagccggtgcgggccgagctggtcgagcggcgcgagcaccgagccttcgcggccgcgatacgacagcaccgcgatgtcctgcttgcgaaagccaagcgacagcgcgtgcgtgatcgcccgcttggtcgcgtcgacgcaggcttcggccaacgcgtcttgcgacgcaccttcttccccgtacgccgacaccgacggatccgaaccgtcgaacgggctgcccgagcgcagctcggccgcgagcggctcgaccctgccgacgatgtcgcgcacgaattcgagcaggtcgcgcgggctccggtagttcgtgagcgccttcagcgtgacccagcccggcagcgcgacgggctcgcgcatgtacaggttctgcagcggatcttccagccaccaccatgcgccgtccggcaccagcaggcgttccagcgcggccgcccacggcgcgtggaaatcctgcccttcgtcgacgaccagcacgtcgaagcgccagcgttcggaaatgggcgtttgcgcgaagcgcgcctcgagccgttcgaattcgccgggcacctggaagtccggcgtataaccgccgtcgcgcgcgacccagtcgcacagctggtggtaattcgcgatcttcgcgccgggcggcgcgatgcgcgtgatgtagtcggcgagcggccggttgaagcacacatagagcacgcgcttgccggccgcgacggcatcgcgcattgcctgcaccgcgagctgcgtcttgcccgagccggccgtgccggtgacgcgcagccggaacggcgcgaattcgagctggcgcgcccatgcggcgagcccgcccgacagccgcgtgacaagcgtgccggcctgcccgacgagcgcgctcgtatcgggcgtgagcgcgagctcgtccgcgaggaaatggtggagtttcggcgcgttcggaaagtgctcgtcgtcctcgggcaggatccgcaggatcacctgcgcgagctgcgccttgcgcgacgcgtcgacgatgcggtcggccgcgacgccggcgatcgacgcgtcgcggatcgagtagtcggggcagtacagcagcgcctcgacaccatagacacccgcgccgagcgcggccgtcaggcgccggtgcagcgtttcctgcgtgcgcgcgagctggatcgggacgttgcgttccttctgcagatagaccttcacgagccccttcggcgtttcgcgcaggaagccggctttctgctcgatcagcagcacgcggccggccgggctcacgacgacgaacgcggcctcgccgaacaccgagaacgcctggtcggcgcgcgtccagtgcacgccgtgatacacagtgtagccgtcgggcagcgcgtgttcgagggccgcgagcgtttcgcgctcgcgttcggccgcgccggtcgcggcgaggcttttccagtcgtcggggatgaggcgggccatggcgtcgggcggcggatgccggcgtgggcgtaaacgggtgcggctattgtactgatccatgaccctgttcacgaccgccgtgccgcgccgacgatgaccgtccggacggggaatggccggcggacgttacccgcgtgcgagccgtttcgcgagatcggcgctgaggatcgccatgcgcgcgggttttcgtagcagacgacgtcgaacgcgcggatcacttcgctgatgtcggcctcgctcgcgcggccggtgagcaggtcgcccgtcagcacgaagatcggcgcgcccgggttgtcggacgtgcgcacggccttgatcgcggtggcggccgtgctgtcgtcgaacagccattcggtcaggaccgcgtcgaacgcctggccctgcagcgcgtcgacgaacggcgcgaggccgtcgaatgcggccgtcgcgaaaccctggcgttcgagatagcggcacagctcggtcgcgctgacgcgatcggggtcgatcaccgcgacgacgagcttgtcgctctccgcgcggcgcggatagatctcgatcttgtgcacgtcgtacgcgttctggtacagcacgccggtgtggcgcagcacgcgccagcggccgttctgttcgtacgcgacgaattcggggcgcgcgccggcttcgagcggcgcgccgatccatgcggtgcacggaatctcggcgacgcccgcataaagtacggcctcctgcgaataggcgccgaccatgccggggtcgagcgtttgcgcgccgaacagctgggcggcgggttcgccgtacgcttcggcgactttcttgatctgcgcgagcgtccaggggctgctgccgcgcagcttacgatggccttgcgaaaagctcaggtcgaggatgcggcatagctcggtggtctgctggcgcttgccgatgccgttgcgggtcatcagctcgcgcacgcgctcggcaaccgcgagggaatccgtggtgattgcttcagtggtcatgctacgggaacggatcgtgacgttcagaacgacgccttgcggcagtctcgacggacagtcttcgtgacgtccaggggcgagccgaccggccacgcgcggaaaagataactttaccgcaaaatggtcgttattcagcgtcgtgaaaggtgcgtttgtgtgaaaggtgtgtcacgacgttaccaccgccgcccgtatccggatgcattaacccctgacaggaaacaatgacgaccacctatccgctgcacgatgccctgacccttggcgatacgccattcccggccgacgccgacgtcgtgatcgccggcgccggcatcatgggctgcgcagccgcgtattacctgggtctgcgcggcctgaaggccgtcgtgctcgacaagtcgcgtatcgccgggcagcagtcgacacgggcgtggggcttcgtgcggcagcagggccgggaagctgccgaggtgccgctgatgatggccggcatgcggatctgggaagcgttagaggaaaccctcggtttcgatctcgaatggcggcagggcggctgtctttatattgcggacaacgaaacggactgggcgtcgttcaacgcgtggctcgcggtcgcgcgcgagcacggactcgacacgcgcacgctgacgcgcgcgcagatcgacgagcgcgtcagcggcctttcgccgcaggcacgcacgctcggcgggctgtatacggcgaccgacgggcaggccgagccgcgccgggtggctgccgcgttcgccgcgcgtgccgtcgaggccggcgcgcgcttcttcgaaggctgcggcgtgaccgcgatcgagacggctggcggcgcggtggtcggcgtcgtgaccgagcgcggcacgatccgcacgcggcgcgtgatctgcgcggcgggcgcgaccagcttccggctgctcgacggcgtcggcatccggctgccgcagcaggccgtccgcggcacctgcatgcgcaccaatgtggtgccgccggtgtcggcgtcgacggtgtgggggcacggcctcggcatccggcagcgcaagaacggcgcgatcaatctcgccgacgatatgcaggtcgacgtcgacctgacgctcggccacctgcgcgggttgagcctgttctggccggagttctggtcgcagcgcgacaaattccggctgcacgtgaacggggctgcctggcgcgatgcgcttgcgcgcatcaacggtgcgaccgggccgatcgagccgcgcgatccgcagccgcagccgaatcgcgcgcatgcgccgcgtgcactcgcgaaactcaagacgatctttcccgcgctgaaggacgcgcagatcgtcgaggcctgggccggcctgatcgacgtgctgcccgacggcattccggtgatcgacgcgccgggcacgccgtccgggctcgcgattgcgacggggttctgcggccacggtttcgcgatggggccgatcgtcgggcggctgcttgccgaatggatcgacaccggcgcgccgtcgctcgacctgtcggcatttcgcgcgcagcgcttcgtcgacgggacgatggtgcggccgcgcagcatgttgtaacggatgaatcgatgcgatgacgtcggccggtcgcggccgacccatcgtagaatcgagcccgcatccttcaggagattccccgttggcatcgccctccgcccagcgccgctcgttgcgctcacgcctgcgtcgcgcgcgcaacccgtggcaggcgccgcgcgcacgcacgctgttcacgcgtcgcgcgacgtcgccgcgccgcacgctgctgttccgtctcggcgcggtcgcgctgctgtgcacgctcgcgttcctcgtgctgtatctcgatcgcgacgggttgcgcgattcgaccaagagcacgccgatgaccgtcgccgatctcgtgtacttcacgatggtcacggtcgcgacggtcggctacggcgacatcgtgcccgtcaccgcacgggcgcgtctcatcgatgcgttcttcatcgtgccgatccgcatcgtcatctggttcattttcctgggcacggcctatcagttcgtgatccagcgcgtcgtcgaggaattccgcatgaaacgcctgcaaaagcaattgtccgatcacatcgtcgtatgcggttatggcctgtcgggctcgatcgcggtgcgcgaattgctcgagagcggtgtcgatccggcgacggtcatcgtgatcgattcgcagcagcaggcgctcgaggccgcgacgtcgctcggcgtgaccgggctgctcggcgatcccgcgcacgaggatctgctgcagcaggcgcaggtgcgttcggcgaaggcggtgatcatttcggtgaccgacgatccgactgcgatcctgctgacgctgtcggtgcgcagcatcgcgcccgatacgaagatcgtcgttcggatccaggagaacctgtaccagcgacaactgcggcaggcgggcgccgatgtgatcgtgtcgtcgacgaagatcggcgcgctgctgctcgcggacgccgtgcatagccgctatatcgtgccgttcgtgaacgacatgctgtcgacgcgcggacgcgcgacgctgctggagcgcgaagcgatgccgcaagaggtcggctgcatgacgaacgtcgtgccgggtgcgatcgtcgtcgggctcgatcggtgcgggaagatttttcgttctacgaggacccgccttgcaggatcgaggcaggggacacgctggttgtgattcagtcggcgcggattccggatccggatgtttgatgcttggttgttcttataaaatcaattagttcaatgatttatggctgatttccattgaacaatgccgggtgtgcgttgggtcatgccaaaacgcacgactcgcgggcacgcccgattcacggccatcaagacaggctttgcccttccttgcgcaaagaccccgtcaggtgacgcaattcgtccagcagcttgacggcgggcgcggatagcgtgcctcgccggcgccggaatgccgtcagagtgcgttgcgcatccaggccttcgatatccagagcgtcgatgacgcccgctttgctttcggtgtcgtacatcggttcggccatccacgagacaaagccacatcgcgctacgaggcttttgagcacggtgaccgaacgggtctcgaccgcgatggccggcattggcaggccgcgggccctgaaggtttcctgcatgtgggcataaggtccggttcccttgggcgtgagtgcccaccgttgtgtcaatgtgtcgtcgagtcgaaggccgcgcttcgcccgcaacggatgatcgagtgccgcgaccacgaaactcctgtcggtccatgagcaatcggagatcgcagcgacatcctcggtttcgattcccgatgtgcaaagcgccaggtcgatttcataagcgagcaggccctcgacgagacgatcccacacgccttcgatcacctcgacgcgcagattgggccatttctccagcacacacgcgatggccatcggcaagacgaggctcgctatgctgcccaccgcgccgaccttgatcacgcctttcgccaggccgcgcatcgcgtccagttcctcgcgcgcctgttcggcttccctttgcagcgacatcgcatgcggcatcaatgcttcgcccagcgcggtcagctgcatccctttggtgtgacgctcgaaaagcgcccccgacggactcctcgagccgcttgatcgatctgctcagcgccggctgggtcatgttcagcatggccgcggctcgtcccaggctacctgcggagacgatcgcggtgaacatcatcaactgctgcagattgaaactcatcgtgtcgaaccagattgaaacggggaagggggcgagcgaggtttcgggtcgcccggcgccagctagggtcttcctgcaagggctcgcggtgcccgctcattgcggccaccgccgagccccgatgacggcgaacagccttttccgacaaggtatccgggcggaattggccgatccggcattccgatagacgcatgccaaaatgtaatgactttgagctttttggcaattttcaaacagggtgccgaatcccatactgcggctcatcccatcaccgccagcctgagtggcgaaccgcagaggattcgagatgcaacgaaatacaagtgggcagccgaccgttcgcgatgccgtcgtggacttgatgcggcgcctcgaattgacgtccgtgtttgccaatcccggctcgaccgagctaccgatgttccgcgacttcccggaggacttccggtacgtgctcggattgcaggaagcagtggtggtcggtatggcggacgggtatgcccaagccaccggcaatgccgcgctagtcaacctgcattcggcagccggtgtcggcaacgcgatgggcaacgtcttcacggctttcaagaaccggacgcccctgatcatcacggccggccagcaggcccgttcgattctgccgttcgatccgtttctgtcggcatcgcaagccaccgagctgccgcggccctatgtgaaatggagcattgaaccggctcgtgccgcggatgttccgctggccctcgcccgtgcttaccacgtggcgatgcaggagccgcgtggtcctgtgttcgtgtccgttccggtcgacgactgggatcagccggccgacttcgtcgaggcgacccggatcagcacccggttccgccccgatccggtacggatcgcggagatcggcgacgcgctggacgactgcgaacggccggccctcgtcgtcggcgcggaactcgatcgtgccgatgcgtggagcgaggccatccagctggccgagcgccacaacgcgcgggtttatgttgcgccgatgtcgtcacgctgcagcttcccggaagatcatcgacttttcgccggcttcctgccggcgatgcgcgaaaaatcgttcggatgctgaacgggcatgacctggtcttcgtcgtcggggcgccggcttttgcgtatcacgtcgaaggcagtggcccgcatgtgcccgatggcgcggcgttgtaccagctcatcgacgatccggctaccgctgcctggaccccggtcggcacgtcggtggtggcgaacattcgcctggggctggtggacctgctcgcccggccggcaccgcgaggccggcccctgccggcgccgcgcgaggcggtcgagcgagccgagcccacggcagtgatgtcggtcgcttatgcgttgcagacgctgtccgaagtccgcaacgcagccgatatcgtggtcgaggaggcgcccagttcacgccccgtcatgcaacgttatctcccgttcacgcgcagtcagacgttctacacgatggcaagcggcggtctgggctacggcatgcccgccgcggtgggtgtcgccttggccagacccggcagccgcgtgatcggcctcatcggcgacggctcggcgatgtattcgccgcaagcgatctatagcgcggtccagctcgatcttccgatcacattcgtgatcctgaataactcgcgctacgccgccttgcaggaattcgcgcccgtgttcggcttcgccgcgtcggatccggtacagggcaccgacctgccagggctggatttcgtttccctggccaacagcatggggtgcgaaggcgttcgagtgagcgacgcgctgtcgctgaagcccgcgctggaagacgcgttgtcttcgggaaaaacgcgtcgtcgaaattgtcgtggcctgaccgcgagtcggtgattcggcaggccggtttttcaagaatattccaggagacggtaatgaatcaggtaacgatgttgatcaacggcgagcgtgcgatggctcgcgacggcgcgacattcgagcgccgtaacccgctcgatgacacggttgcctctacggcaccggccgcgactgtcgccgatgcacaagcggcggtgcatgcggcggccgccgcgtttcccgcatggtcggcgatgggccccggcgagcgacgcgctctactgaatcgggccgcggatgcgctcgaagaaaaggcgacgctttcgcgctggcaatggcaaccgaaacgggcgcgtcccgcctgtgggcggatttcaacgtcaagcttgcggccgacgggctgcgcgaagcggctgcgatgatcacgcagatctccggcgaggtgattccgtcggacgtgccgggcagtcttgcgctcggcgtgaggcaggccgccggcgtcgtgctcgggatcgcaccgtggaacgcgcccgtcatcctcggcgtgcgtgccatcgcgttgccgctggcgtgcggcaataccgtcgtgctcaaaggttccgaaacctgccccgcgacccacggcctcatcatcgaagcgttacaggacgccggactgccacgcggtgtcgtgaacttcgtcacgaacgcgccggcgaatgcgggcgacatcgtcgaagcgatcattgccgaaccggcggtcaggcgggtgaacttcacgggttcgacgcgcgtcggccgcatcgtcgcgacccagtgcgcgaaatatctgaagccttcggtactcgaactcggcggaaaggcgccgtttctggtgcttcacgatgccgatatcgaagcggcggttcaaggcgcggcattcggggcgttcgccaattccggccagatctgcatgtcgaccgaacgcatcgtcgtcgacacgaagatcgccgatgaattcgtcgcgcgactggcggaaaaggcacggagcctgccgcttggcgatccgagaaaggggccgaccgtgctcggctccgtcgtggacatggcgacggtcaggagatgcaacgacctgatcgacgacgcgctggcgaaaggtgcgaccctggtatgcggaggaaatccgagaccacgctcatgccggccacgttgctcgatcacgtgacggcggacatgcatatctaccgggaggagtcgttcgggcccgtcaaggcgatcgttcgcgtcaatggcgacgaagaggccatcgcctgcgccaacgacaacgaatatggtctgtccgcggcagtcttcagccgtgacgtcgcgcgggcgttgacggtcgcgaagcgtatcgagtccgggctttgccacgtcaatggcccgacggttcacgacgaggcgcagatgccgtttggcgggatgaagtccagtggtttcgggcatttcggcggcaaggccgggatcgcggaatttacggatttgcgctggatcaccgtgcaaacgacgcctcgtcactatccgttctgatcgttgccgcggtcatggcacgtgtttctcaccatggacgggatgggcttccggatggtgggcacgaacacaataacaacccgatatcgttgagacgccttcgctcctgaaacgacgagcgaccggcttaaggagactgcaatgcccgtcatcaatttcgagtcgtcgctcgatcgcgcccggttggagtcagaccgtcgcgtcggaaaacgaattacgcaggactgcgattcagaattcgccggtctgtccgggagagcgaaatgaacgatcgtaatccgcctctgccgatcgtagacatcggccgtgcactcgatgacggaccgttctcggcgttccagcgaacggtcgtcctgctcgccgcacttgcgatcgtgatggatggcttcgatggtcagctcatcgggttcgccattcccagcttgatcaaggaatggggcatcacgcgcaacgcatttgcgcccgccgttgcggccggcctcgtcggcatgggtatagggagcgcgttcgccgggctgttcgcggacaggttcggtcggcgctgggcaatcatcggcagcgtgctggtattcggcttggcgacgagttcgattgcgctatcgccggacgtgacgaccattgccatcctgcgcttcttcgcgggactgggtatcggcggcgcactgccgagcgcgacgaccatgacggcggaatttacgcccgctcgccggcggacgctcgcggtgaccgcaaccatcgtttgcgtaccgctgggggcatgcttgcggggctattcgcgagtgtcgtgcttccgcattacggctggcgcgggctctttctgattggtggcacgcttcccgtcgcactggcgctcctgctgtatttcgtcatgccggaatcgccacggtatcttgcgcgtcatcaggaacgctggaatgaactgcgtcacctgctgtcccgcatgtcccgatcgattcagccgcatgccgtattcgccgatcagaaggagcagaaagcggggcagcgcccaggctttcgcgcgttgttcgcggaccatcaaggccgcgacacgctcgcaatctgggtcgctttcttcatgaacctcgtcgcggtctacagcgcattcagctggctgccgacgatgctggcaggcgagggactcagcgcttcggtggcgggttcaggtcttaccgcctacaacctcggcggcgtactcggcgcaatgggctgcgcagtggcgatcggccggttcgggtcgcgctggcctttgctcgtatgctgcctgatggcgtccgcgagcgcgcttttcctgcgcggtctcgacgtctctgcccacacgacgttgctcgtgttcggaatcgggttgcacggcctcttcgtgaacgcggttcagtcgacgatgtatgccctttgcgcgtacgtctatcccaccgagattcgcgcgaccgggaccgcatccgcgctcgcgttcgggcggctcggcgcgattctcagcgcgttcgcgggggccttcgtgatcacgcagggtggagcgtctgcgtacctgggcatgctgggtgccgcgatggcgatggtttttatctgcctgatgatcgtgcgtcgtcatattccgcccatcaagggcgcttgagatcagtgtcgagggcgacgtttgtcacgcgctccgcgcagggcacgtaacgatgtcgctcatgttgaaccgaatgacgaaaaacgtctgacagtaccttcagttggagatggcatgcgcactcaagtaggcattattggcgccggtcctgccggcctccttctttctcatcttttgcatctgaaaggtatcgagtctgtcgtgctcgaaacccgccgacgcgagcagatcgaatcgacgatcagggcaggtgtactcgagcaggggacgatggacctgcttgaagcgtccggtgtcggtgagcgtatgaaggcagaaggagcgttgcatcacggctttgaactcgccttcgacggaaagcggcggcgcatcgacctcaaggcattgaccgggcgggccatcaccgtctatgcgcaacacgaagtcatcaaggatctggtggcggctcgggttgctgcaggcggttctatcctgtttggtgtcgcggatgtcttgattcacaacatcgacacgtcggccccgtcgatacggttcgtgcatcaagggcaatcacatacgctggactgtgatttcgtgatcggatgcgacggttcgcaaggggtgtcccgttcggcgattcccgagagcgttcgccgcgatttcgagcgcgtctatccgttcggttggttcggcattctggtcgaaggtgcgccgtccgcagacgagctgatctatgcacgtcatgatcgcggttttgccttggtcagtacccgttcgccgacggttcagcgcatgtatttccagtgcgacccgaaagattcggtcgacaactggtccgacgaccggatctgggccgaaatgcacgcacgcgtcgactccgccgatggtcagtgcgttgtcgacgggaagatctttcagaagaatatcgtcggcatgaggagcttcgtctcgacgacgatgcagcacggccgactgtttcttgccggcgacgccgctcatatcgttcctcctaccggagcaaaggtctcaacctggcagtctccgacgtacgaatcctgagcagtggactcgacgcgtattaccggaccggcgatgaagcgcaactcgcttcgtacagcgagcttgcgctgaaacggatctggcgcgccgagcatttctcctactggatgactcgcatgatgcatcgtctcgacgatgcctcgccgttcgaacagcagttgcaggttgccgagctcgagcatgtgactacgtccgagactgcggcgaggtccatggcggaaaactatgttgggagcgttgccgtctagctttcgactttgcgtcgttactcggtcgtcttccgcctcgaatgaccgagggagacgcgcgaaaccggcgtgcagcgcgtctcgtgcttttcgcatcacgatttactctgacagtaccccgatcatgacaacaggatttcccggcattttctccgtcagcgactatcgtgacgaagccagacggcggttgccacgcatggtgttcgactatctggaaggcgcggcggacgacgaatcgggattgacgcataaccgttcggcgttcgacaggttgcagttgttgccgcgccggctgtcggatgtcagcacgcgagagcagtcggtgccgcttttagggcggctgattccattaccgctggtgatcgcgccgacgggcctcaatagcgcgttctggccgaacggcgacctcgcacttgcgcgcgcagcggcaaggccggtattccgtttgcgctatcgacggcttccaacatgtccatcgaagaggtggcaaaggggccgacggggacctgtggtttcaactgtacgtcgttcatcgcaacctcgcgaagagtctggtcaatcgtgcccgttcggctcgctattcgaccttgatcctcaccgcggatgtcgcggtgaacggctttcgccgacgcgatcttcgcaatggctttgccatgccgttcaaggcaagtgcacgtgcggccgtcgacggactgtcgcacccgcgctggctttggtcctatctgatgaacggcatgccggagttgaagaatttcgccacggacgatgcatcggacaccgcctcccaggcggcgattcttcgccggcagatggatgcgagcttcagttgggacgacctgcgccgtttgcgggacgaatggccgggcaagctcctcgtcaagggcatcgtgacggccgacgatgccgcgcggtgcgtcgcgctcggcgcggacggcgtcatcgtttcgaaccacggcggcaggcaactcgccgacctgcccgcgacggccgacgtgctgccggatatcgtcgagcgcacctcaggcacgacggtcattctcgacagcggcatccggacgggggccgacgtcgtcaaggcggtcgcgctggggcccacgccgtgatgctggggcgggccaccttgtacgggctggctgccagagggaaaccggtgtgagcgacgtcatcgacatgatcaaacgggaaactgaccggacgctcgccctcatcggttgtcgctcggtgggcgagctcgatcgcagctatgtttcgaagcggccgtcataggcaactgcgcattgacggcggattctggatgcgcaattgttcggggtgacgctcccgcgtatttgccgccggaaccttgtgccatgaatcaagtgacgaccacggatcattaccatcgcgacgaccggcttttggcatgggcggatcaggttcgggccagttgcgtccccatggttttcaggaccgaatccgatcagggatttcgtggcgagatttccagcgtgaacacgggcggagtgtgtgtcgcggatctcggcggtcgatcacgtcgcggctcacgactgggacgacgtgcggcgcacggcggacgactacctgctcgtgtcgatacagatcgaagggcgaggtgcactcgagcaggatgcccgcaccgcgttcgtcgaccctaccgacatggtgctgttcgactcgtcgcgccatttcgtctggcatttttccggacagcactacacgatccgctttccccgccaggcgctggagaaattggtgccgtgcggccggcagcacaccgcggtgcgtattcctgcggccaccgggatacgccgtatcgccgcggaccatatcgcgtcgctgcaccgagtgctttcgtcagacgaaggcgcgatgaccgcttgcgagaggcttggcgatgtgtccgccaacctggtcgcgctggcgttggcggattatttcaacacggttccgctgcccagatccaacgtgaaagagatgcatctgctgcgggcgcgcgcgttgatcaaggacaggattcacgacccggaactgggacccgaactgatcgccgatgaactgggagtttccagccgttacctctatcgactgttcgccgaggccggggagtcgatcggcgagaccatctgtacggccagactcaacgggtgcggcgagtggcttcggcaacgcgcgtacgctaaccgctcgattaccgatattgcgatggcttggggtttcaataatgcatcgcatttcagtcgtacgtttcgacgtcacttcggcgtgtctgcgcgcgactaccgtgcgaagcatcgcgacgttagttgaatcgcccctgagcgggctgcgcggtaatcccgccggctggcagcataagtaaaaatcctgttctgtcagagtcaagcgtccgccatattggccccggacacttcctctacaacgttgcgggcgtcccgtcccgcgagtcgtggaggagtatcttggctctcaaccatccccaatataaggcggctgtcgtgcaggccgccccggcgttccttgatcttcaagccggaatcgaaaagtccatatgcctgattgaagaggcggcgcaggccggcgccgccctgatcgcattccctgaagtgtggctgccgggctacccgttctacatctggctgggtacaccggcctggtatatgagcaaaggctatgttcagcgatatttcgacaactcgctgagctacgacagtccggaagccgatgcactgagggccgcggccagaaaaaccgcatcacggtggtgatgggactctcggagcgcaagggccattccttatatatctcccaatggatcatcggccccgacggagaaaccctcctgcaacggcagaaactcaagcctacccacctcgagcggacggtcttcggtgacggcgagggcagtggcctgaccgtaatcgacagtccgttgggaaagctcggcgggctttgttgtgccgaacacgtgcagcctttgaccaaggccgcaatgtatgcgcaaggcgaacaggtccacgttgcggcctggccgagcttctcgctctatgaatttgccagcgcattgagccaccaggtgaacaacgcggtttcgcggacgtatgccgtcgaaggaggttgcttcgtcctcgcgccttcgacagtcgtcaccgaggaaatgatcgagagcctttgcgacaccgaggacaaacgtcagctgttgcgggcaggcggtggccatagcgtcggatacgggcccgacggggcggaactgttcgacaagatcgacgaaaccgcggaaggcctgctctacgccgatatcgacctcggcatgcaatcgctttcgaagtgcgttttcgatcccgtggggcattactcgcggcctgacgttctgcggttgctgatcgaccggcgaccgcgcccccggtcaccgagatcctcgatggccccgccgggacggtcgccgatgatcaaacatcgtcggacaacggttgctcgccggagctcgcgagaagtggcggagatcggtagcggcctgtcgggctcgccatgcgattccgtggcgagccggacggaggttttcgtgtcgctgccgtattggctcgataccgattgaagcgggatggttttctttgaaacaacagccattcaatcacgacgatatatttaggatatcgatatgaactacaaacaaaatcgagaatacgaatggaagatggtcatctttcttgcggtgctgttcggcatcgttggactcgatcgtctggtcatcgtgtatctgtttccggttcttctgccggagctcaaattgaacaacacgcaggcaggcgcaatcgcgtcggttctcgcgttgacctgggccatttcgacatgggtgctcgggagtctgtccgatcgccatgggcgtcgcaagattctgctggggtcttcgatcttcttctcggtgatgacctcctttaccggcgtcgccaagtcgttccacggcatgctgctcgtgcgaggcctccttggcgtgggcgagggcggcgtcttcagcgccagcgtcgcgacgatcgacgaaatatcgacgccgagccggcgcggcttgaatctgggcattcatcaatcgtttttcccgcttctgggtatcggccttggaccgatcatcgctacccagctcgtgatgcacatgcgctgggagtgggtgtttttcgtgctcggtattccggggcttttgctgacgttcctgatcggcaggaccatgcgaaagacggaggccggtcgcgacaggcaggtccgggcggcctcgggcggcccgttgaccgtgctgagatacaagaacatctggttgaccacggtcatcggatcgctcttccagacgggcctgttcgtgttctcgacgttcgtcgcgctctatctgaccaaagtcgcgggcctcagcctcggcacggtcggcttgatcatttccggatggggtttcggcgggtttatcggaatggtcgccgttccggcgatatcggatcggctcgggcggcgtatcgtgctcgtcgtctccgcggcttgctatggcatcctgatgttggcgttcgttctttgtcacgcttctccgatcgtgatgttcatcaacctctttgctgccgggatttgcggcttcggcatcgcacctctctttcttgccgtgattccttgcgaatccgtaccgtccacgctgaccggttcggccgtaggcgttccgaccgctgtcagtgaactcattggcggggtcctgatgcccgtggttgcaggtgggcttgccgatacgttcggtctgggttatccgatgctgatcgtcgggggcgtgtcgttggtgagcgcgctcgtggggatgtttctcgatgaaacggtacccgctgcgacgtcgaagcattccgtctcgaacatcgacgcggcctgaacgtccgtcgaagcgcaggcgaatttcagatcgttacgcggactcactcgatcgaggccgcctgcgtcggccgggggcggtatccgcggcgaagaggggcgctgccagggttggctacgccatcgtcatttctgaagatgcgctacaaaaaagccgacgcgcaatctacgaagaccgaaatgcacgagagacgtagatgccaaccctgccgcagctttcagtcgtcgacgcaaaggcgcgatcgatcgacgcgagatatcctgcctggaatacgttcaggcgctggtggatcaacacgccaaaaccgagtcgctgaacgggttcgtgtttttcgaccgtgacgcgctgttgcaagcggcgcgggaacacgatgaatcgctcatagcccgaacgggccggttgccgctttccggcattccattggccatcaaggacaacatcgactgcgcgggcatgccgaccgccgcgggaacggcagcgctccgcgacgccgtacctcgagctgacgcacccgttgtggcacgcgtgatcgacgcgggcgcgttggccgccggcaaagccaacatgcacgaactcgctttcggctgcaccagcgacaacggatttttcggcccggcccgcaacccgtatgacccgtccagaattccaggcggaagcagcggcgggtctgccgtgctggtggcgagtggtgcggtgccggcggcgctcggcaccgacacgggcggatcggtgcgcataccggcggcgctgtgtggattggtcggctttcgtcctacgcacggacgctatccgtccggaggtgtcgtgccgatatcgcccacgcgtgacacggtcggcccgatcgcccgcaccgtcgccgacgtgatgttgctggacgagatcttgtccggaaacggttcagcgcttcccgcggtcgacgatacacgtggctttcgcctggcagttccctattcgacggtgtgggaggggctgtcacccgacgcccggccggtactcgaccgtgcgctgcatgcaagtgccgcggtgggcgttgggggctcgtgccggcatcggtacgaaaccgtattggcggtttagtctcttgtatcggacgattcgccgcgtcgcgcgtacgtggtcgtctgccgcgccgttcaatcgtcatgacggcggggtcgttccggccgcggcgacggaggcagcaagctccgcgcggttggagaatcccttcttgtccatgatccgccgcaaatgggtgcgcacggtcgacaggctgatgcagagaagacggccgatatcctgatcggtacaaccctttgcgaccagctgggcgatctcgttctcacggtccgtgagccctgtcgcgctgcctgtccggcgtttgatcgcgcggcaaaggaacggctcgatcgcatcgagcacgagtttgtcgcgcatctcgaactcaggccgattcctcgttcgccagattctcaggtcgctgagctggcgttcgccgtcgaagacaaacacgttgattccgtgatgcaacccatcctgcgcgagaaactcgttgtagaactcgcttttctccagtgcaggccggtccatcacttcttccaccaacgtggccctgcgccgcttgcagagttgcgccgtcatcgggtcattgtgctggtaccagctcgtgtagcgacgcacgtgatccgagtcgacattgactgcaatcgggtcggcgtacatcccttttcggcatcccagttgtaggagacgcagaaatcggatcgcagcagccgggtcaggtctgacaaaacgacgcgcctgacatccacgatcggcccgagctcctcgagccgcccgatgatgtcaccgaaaagtcggagttcgtcgagcgtgagatcgtgaacttgtggcttcaagggtgcctcatcggtaggtggaatcgggagacagcatgcgcaacagcctcgaaagactggttcgcattacacatcaagcatagcagggcaaaaatcccgaacagcaacgaacttcactgccattgcctgtccgttgtattcatgccgcagtcaggtccactgcctattgcagatcggaaggggtgttcgcgagggcgcctgaatttcttgagcgcgggctcaggccgagtttccctgtcgatatttctaacgatggggctcaaaaacggtgctcatagagtagacgcgcagtgggaagcggacgtgccgagactgttcgttgtagcgaggcaagctggaggattacccggagacgcctgcccattgaccaaacgattccgatgcatttccagcgggacgttttcctcagtcattttcgtcaacgaaagctacgcataaaattaggaaagcgatatgaatacggtcatcaagcgaagcatggtggtgtgcgccgcggtcggatgcggcgtggcacatgcacagtcctcagtgacgctgtacgggctggtggatgcgggtattacgtacacgaacaatgcgacatcgagcaccggacatggcgcgctcgtgcagtttgcatccgggtcttcgcagggagatcgctgggggctgacgggtaaagaggacctgggtggcggactcaaggcgatcttcacgctcgaaagcggctttcaactttccaacggggccttggcgcagagcgggcttctgttcaatcgcgcagccttcgtcggccttgacggacgcttcggcacgctgacgctcgggcggcaatacgacttcatcggcgatatctttccggcgtactcgattgcgggaaatacggcagcgggcatcctggggtggggatcccggcgtatgcggctggcggatatacgctcgataaccgactgtggggcgataacgtcaacaactcggtgaagtatctttcgccgacgatttcgggtttcagtgtcggcgccatgtatggtttcggcaacgtcgccggctcgttgggcaccaacagctcgatgaattttctgctgaactacagccaaggcgggctcgccgcatcgctgtcgtatttcaagcagcataacgcgacgacttccgcgaatttgaccgaatacgccggcggtgcaacctacagcctgggaaagcgcagatttttggtgtcgtgaccgatgttcagttgagcagcggcacccaggctcgggcgctgacctacgacggtggcatgacttactttatcaagcccgatatttcgcttggagcagggttccagtttcaacagcgcaacaacggcgtcggcagcgcgaaccaggtgaccatcggggcggattacttcatttccaagcgaacggacgtgtatttcgttggcgcgctcgcgcatgatcatgcacacggcgctcaaatcgaagcagcgctcggatcgccgtccagcacgagttttcagactgcggcacggatcggcattcgccacaagttctgacggttgcgggtcgagcgcgatggcgaaccgggggcgcctatttgtcttcgacgcggtatcggccgctacatcgccgcaccataaagatgatgcgcgtcggtcagtgcatccgcgacgagttccaggccgtcccggcactgctcccgatcctgcggcccgccaaggcagatacggatcgccgccggcgggtcgccgtccgtcgaaaatgccgcgctcgccacggcggcgacgtttcgactccgcagatgctgcgccagatccggtgcggtccataggcactcgcccggaatcggcaaccagagatggaagccgtcggggtgggcatcgaaaggccatgcgccgagaatccggcccgcgatcgcctgccgtgcatgcgcctccgatcgaatcgcggccagcatctcgcttgccgtgccgtcattgatccactgggtagacagcagcatcgtgaacgggctcggcatcacggtcgtggcgcgcaatgcgccggcgatccgctgtgcttcgcgcaccgtcggcgcgagcaggtaagcgatgcgcaacccggcgccgaagttcttcgacatgccggtcacgtagtaggtcagttctggcgccagcagcgccagcggggcggtgcgctctgcggcagcatcgcataggcatcgtcctcgatgatgggcacgttgtagcgtgtggcgatatcggccaacgcttcgcggcgccggaacggtatcgtgagcgtgctcgggttctgcagggtcgggttgcagtacagcgcagcgggttgtccgcttcggcagagcgattcgaaggcatgcggcaacggcccgtcgtcgtcccgcggcagcggctgtaaccgcacgcccagttgcgatgcgatggccttgatgccggggtaagcgagcgaatcgaggcagatcgagtcaccgcggctcgcaagccgggaaacgagcgcgacgagggcgctgtggattcccggacaaacgagcacggtatcgctgctgcagccgggcaggcgattggccagccatgcgcggccggcggcgcgatccgccggtgtgccgccgaaatcctgatatcgcatcaattggtaagggtccgccgcggcgaacaatgcggcagccgattcctgcagtcgcccggccatctcgggcggctccggtggcatgttcatcgacatctcgatgctgctcccgcccgacagcgggatcgtccgggttgggccgcgcacgaatgtaccgcttcctgcccgtgtatcgagcaagccgcgcctgcgggcttcagcatacgcgcgggctaccgtcgtgtagttcaggttcagcgcaccggcgagatcgcgcagcccgggtaggcggtcgcgtggtttcagccggcccgccgccaggtcttcctcgatcaggtcggggatcagcaggtacgccggcttcctgctttccaggagtcgcttcgaccaatgatggattatgtaatccatacctgtttccatttgatgattcatcaaaacgttagcatggcgcattaatcggaaatatctatatcgccattctgaagccagatgattgcattgatcgcatcatgtatcggattgatgcatggatgcacgctcgatgcgcacgcatgcttgctggttgcttcacacgggtgcgcgccgtcgcccggacgggacacttcctgtccgaaccgtattcggtcacgcaaggatcggaccggctgcatcggcatttatcgattgaatgatcggagagtgatcgcatcaggtcggtgcctggttggcatatgcgttgcgttaatgagatcgcccggactcgaaagtgttcgggaatatcactgaactcattatcaaacggagcgtgccatgcccgcagtcaatcagccgttgcacaagaaggagatttcctcgtcgattacgaggaaaaggtgttcgaagacgtcaaggcggaaccgggcgagaaagcgctcgtgacgttccacacggttgcgttcgagggatcgatcggcttcgtgaacctgctgcaggcgactcgcctgcagcgcaagggattcgagacgtcggtgctgctctatggccccggcgtgacgctcggcctccagcgcgggtttccgacgctcggcgacgaggcgtttcccggtcatctgaacttcaacaagcaactcgtcaagttcatggaagaaggcgggaaagtctacgcgtgccgttttgcgctgcaggcgctctacgggcatggcgaagcgtcgctgatcgagggcattcgaccgatcaatccgctcgacgtgctggatatccagctgcttcaccgcaaggagaacgcgctggtcatccatacctggaccgtttgatcgaatgacgggtgccatcatgtccgacaaacgcatcgtccgggcggcagccgtccagatcgctcccgatctggaacgcgccggcggcacgctcgacaaggtctgcgcggcgatcgacgaggccgccggcaagggcgtccagctgatcgtctttcctgaaacattcgtgccgtattacccgtacttctcgttcgtgcggacgccggtcgcatctggcgccgatcacatgcggctgtacgagcaggccgtggcggtgccgggccccgtgacgcatgccgttgcggagcgcgcgcgtctgcacgggatggtggtcgtgctcggcgtgaacgagcgcgaccacggcagcctgtacaacacgcagctgatcttcgacgtcgacgggcgcctcgcggtgaagcgccgcaagatcacgccgacgtttcacgagcggatgatctgggggcagggcgacgcggccggactcaaggttgcgcagaccggtgtcggacgggtcggtgcgctcgcgtgctgggagcactacaacccgctcgcccgttatgcgctgatgacgcagcacgaggaaattcattgcagtcagtttcccggctcgctggtcggcccgatctttgcggaacagatcgaagtcacgatccgccaccacgcgctggaagcgggctgctttgtcgtcaatgcgaccggctggctgacggacgcccagatcgagtcgatcacgggcgatccgaatctgcagaaagccctgcgcggcggatgcaataccgcgatcgtgtcaccggaggggcagcatctggccgagcccttgcgggagggcgaagggatggtgatcgccgacctggatatgtcgctgatcaccaagcgcaagcgaatgatggattcggtcggccactatgcgcggccggaactgctgagtcttgccatcaacgatcggccggcgacgacggtgaccccgatggggatcggcgtgccggccgcacgcgacttcgagggacattgccatgagcgcgaacgcgaaaccgtcggtgcagagccggcaattgatgactgaactgcagtcggtcgggctgcgcctcgccgatccgcgggtgggcgccgcgagccggcgcggcggcgccgggccgtccgatcacaaggccgtgacggtcgacggcgtgaccatcatggtgccggtgcacacgagtaccgcgtgggattcgccgttcgtcgcggcggcgcccgatgcggcgggcgtcagcctgctctcgcgcggcaccatcccgatcgcgagcatcagctttccgtcgagcccgcgcttctacgcgttgcagacactggagggcgtgccgtattcgcacatcgcgacgctgcatggcgccgacgtgctggcgaccacggtgctgcagacctgcattcgctacgagagccggcgcaagacctgccagttctgctcgatcggccagtcgctcgcggccggccggacgatcgcccgcaagacgccggaacagctcgccgaggttgcgcgcgcggcggtcctgctcgacggcgtcaagcacatggtgttgacgaccggcacaccgccgacgccggatcgcggtgcgcgcgtgctgtgcgaaagcgcgttcgcgatcaaggcggccgtcgatctcccgatccaggcgcaatgcgagccgcccgacgacgacagctggttcgaccggatgaaggcaagcgggatcgatacgttgggcatgcatctggaagccgtgacgccggcggtgcgcgaacggatcatgccgggcaaggcgagcgtgccgctgtcccgatacatggcggcattccgcgcggccgtcggcgtgttcggccgcggccaggtcagcacctacatactcgccgggctcggcgacagcgcggccgcgatcctcgacatgtcgcgcgaactgatcggattgggcgtgtatccgttcgtcgtgccgttcgtcccgatcagcggcacgccgctggagagtcatccggcgccgtcgccggagttcatgcgggcggtgctcgaaccgctcggcgccatgctgcgcgacgccggcatgcgctccgccgacatcaaggcaggctgcggaaagtgcggtgcctgctcgtcgctttcgacctacgaggggtgagcatgtactgcgcagagatgggactggccgactgccgcgacacctaccggcccgccgaataccggatcaaatgggcggcgcttccgtgggaaatcgacgaagcgtacaaactgcgccgggcggtgttctgcatcgagcaggggatcttcgccggtgacgatcgcgacgatatcgatcgccacgcgcaactgctggtcgcagtcagctgctgcgcggggctgcccgagcaggtggtcggcacggtgcggattcatgaaaccgtgcccggaacctggatgggctcgcggctggcggtgcatccggcatttcgcaggcagggcaggatcggctcgatgctgatcgcacttgccgtcagcagcgcgcatgccgaaggttgccgaaccttcgtcgcacacgtgcaatcgcagaacgtgccgctgtttcgtcggcttcactgggatgcgctcggcgaagaaacgttgttcggacgtcctcatcaactgatgcaggcccggctggcgcactatccgccgtgcggcacgccgttcgagggtttcgtcctgcgctcggaggtgcggcaatgagtgtcgacgatcgcatcgcgacgctgcgcgcaagtcgcggcttccagcacaagcacgacatctccggcgtggtcgcatcgctggcagcgtcattgccgaacggcgagcgggatctcgcgcaggcggtggcactcggcgacgactgcgcggcgattcccgacgcggacggttacctgctgttcgcgatcgagggcatggtcggcgatttcgtcgagtcgatgccgtggttcgcggggtacagcggcgtgatggcgaacgtcagcgacgtctacgcgatgggcggacggccgatcgccgtcgtcgatgcattgtggagcgacggaatcgacgccgcgcggccggtgctcgccgggatggccgcggctgcgtcggcgtatggcgtgccgatcgtcggcggccacagcaacacgcgcagcgcgcaggggcagcttgcggtatcgatcctgggccgggcccgcgcgctgctgtcgagcttcagcgcgcggccgggcgatcgcctgatgatggcggtcgacctgcgtggcgcattcgaggacccgtatccgttctggaatgcgtcggtcggcgcgccgccggcccggctgcgcggcgatctcgagatcctgccggcgctggccgaagacgggctgtgcgatgccgcgaaggatatctcgatggcgggcgtgctcggtacggcgctgatgctcgtcgaatgctcgcgcgtcggcgcgcgcatcgaactcgacgcgattccgcgtccgcccggcgtcgacttcgatcgctggctgacggcctttccgagctacgggttcctgatgtcggtccggccggcgcatgccgacgcgatcgtggaacgcttcgcggcgcgcgggctcgcgtgcgccgtgattggcgatatcgacgccacgcgcgaggtcgtcgtcgaagaagcgggcgaaacggcggtgctgtgggatttccggatcgaaccgtttatgaccggcggcggaggtgtccgatgagtggcgatgcgttgcgcatcgcgctgctgacccattcggtgaatccgcgcggcggtgtcgtacacgcacttgaactcgccagtgcgctgcacgaagcgcgcagcgacgtcaccgtgttcgcgccggccgcgccgggcgaggcgatgttccgcgatgtcccgtgccgcgtcgtgctggcgcgcgtcgatggccgtcccggcagcgtcgcggaaatggtgtccgcgcggattgccgcgatcaggcgcgcattgctggagcacgaggcgggcgggttcgacgttctgcatgcacaagacagcatcacgggcaatgcgctggccgagttgcggcagtcaggcgcaatagacggcttcgtacggaccgtgcatcacctcgacgtattcgacgacccgcagctcgagcgctggcaggaacgtgcgtggcgcgcggcggaccaggtgctgtgcgtgagcgccgtgtgggcggccacgatgcgcaagacgttcggggtcgacgcaagcgtggtgcccaacggcgtggacgtcgcccggttcgctcgtgcggaccaggcggacatgcaggcggtgcggcagcggtacggcctgcacggcggcccgattgtcctggcgatcggcgggatcgaggagcgaaaaactcgatcgcgttgctcgaggcgttcgcccggctgcgcggcacgatgcccgatgcacggctcgtgatcgggggcggcgcgagcctgctcgatcacgacgcatacgcacgccgcttcgtcgcgcgcgccgctgccctcgggctggggatcggcgtcgacgaacccgtcgtgtcgacggggccgctcgacgacgcggcgctggtcgcgctgatgcactgtgccgacgtggtgtcgatggtgtcgatccgagagggattcggcctggtcgtgctcgaggggcttgcttgcggaaagcccgtcgtcgtatccgaaatcgaaccctttaccgagtatctggacgagcacgcgtgcgtgtgggccgatcccgccgatgtggattcgatcgccgacgcgctgcgcgacgcgctctcgggacggcgtgttcccgatttcgcacatgccgtccccgctgtgctgaaccgctactcatgggaagcgagtgcgcgaaggcatctggatatctaccgggcccggctggcgcagcgtgcgcgagtcgtgtccactgaatgaggaggaatcatgccggtcatgcattttcgggttcgttggcccgatcagtcggaaacaaattgctattcgccttcgaccgtcgtgtcggaattcttcacgcccgagacgcagtacgcgctcgacgacttcgtcgagcgagcccgacgcgcactgggtatcgcgtccgatcgcgtccgcgagaaatacggattcgcgtgctcggccgcgatggacgagctggcacggatcgaagcgaacgcggaacgatttgcgccgcaggacgacgcgaccgtgaccgtcatcgaactcgtttgaggcgtatggcacgtgggaatccactgtcttcttcaacacacattcaggactgcatcatgtcgagcgaacccgttgtttcatccagcctcccggattccgattcccatctgcgcgtagccgtcatcggcggcgggcaggcggggttgtcgatcagctactacctgaagcaggcaggtatcgatcatctcgtattcgaaaaggagaccgtgacgcacacgtggcgcaagcagcgctgggacgcgttctgtctcgtgacgccgaactggcagtgtgcgctgccgggttatccgtatcgcggtgccgatccgcacggcttcatgacgaaggacgagatcgtcgagtatctcgacggattcatccgcagcgtcgatgcaccggtgctggaacataccgccgtcgagcgtgtgacgcgcgacgcggacggacgttatcgcatcgcgacgtcgcgcggcgcgtacacggcggatcaggtcgtcgttgcatcgggcggctaccatcggccgatcgtgccgcggatggccgagcggttgccggcaacgatcgtccagatccagtcgtcggaataccggaatccggccgcattgccggacgggccggttctcgtggtcggatcgggacagtcgggcgcgcagatcgcggaagacctccacctcgccgggcggaaggtgttcctcgcggtgggcgatgcaccgcgctgtgcccgtttctaccggggcagggacgtcgtcgactggctggccgacatgcagtactacgacatgccggtcgatgcgcatccgctgcgcgaaggcgtgcgcgacaataccaaccactatgtgaccggccgcgatggcgggcgcgatatcgatctacgccgctttgcggccgaagggatggaactgtacggccggctggaggatttcgcaggcgggcagttgcgcttctccgcggatctgtcggcgcagctcgacagcgccgacgatacgtacaaccggatcaatgccggcatcgatgcccatatcgagaagaacgggatcgcggcgccgccggcgacgcgctacgagcccgtgtggcgtccggccggcgagcgcacggcgctcgatctcgcggccagcggcatcgcatcggtcgtctggtgcatcggcttcaccccggatttcagctggctggatgcgccggtattcaacggccgcggttatcccgcgcaccagcgcggtgtgacgccggttccggggctctacttcgtcgggctccctggctatatacgtggggttccgggcgattctccggggtggcgcgcgatgccgcccatatcgtcgaccagatccaggccgggacgacggccgcgcggcgctcggccgaaagcctggccgcctgacgccgatgcataccgccatccattgctatcgggccggcatgccgcaactcgcgcacacggggctcgcggagaactggctgctcaaggagtgcgggcagcgtcactgggacgcgctggccgcgcacggcggccgcgacgtccccgagttcttcgacgacgaggggcggcgcgcctatgcgtcgttcgttgcggtgcacgtcgacatgaaccgccgtcacgcggttcgcgagaacgacacgttcgcgcttcatgtcgcgcttcgcagggtcggcccgattcgccatttcagcgagcagcggatccggcacggcgacgacgaagccggcatcgtgcggatgatgtcgacgttcgtgacgcgcgaacacgccggcagcaaccgctcggtggcgaaggcgcgcatgaccggcatcgacggccgcaccggaccggtcccggccgatgcgctggcgatggcggaacgtgcgaagaagttgcgcgtgcgggatgcgtcgatcgtgccggcgctcgccggcctcgcggagggcgacggtgcaagcgtctcgtttctgccgtgcccgaacatggatttcaatggcgcggacctgctttacttcgccagcttccaggcattcgtcgaccgcgcggaatggcagcattaccgcttcgagcaggccccgtgctggcggcgcgtcaactgtactttcatggaaatctcgacatcggcgattcgttgaccgtgcgtttcgcgcgtgctcgatccgatgcggatggcctgttgcactggagcgaaatcgtgcgcgacggcgacgggacgaagattgccgatgtgatcacgcaaaagcgctggagtcgggcatgaacgaagcggcatgcatggagccgggcaccggcgtggagaacgtcgcgcggaacgatcgaggcgcgcgcgcggtgccgctgcggaaactctacacgcgcagcgatctcgacgccgtcgcgcatctcgacggcatgcccggcgcgtggccctatgtgcgcgggccgtacgcgtcgatgtataccgatcgcccatggacgatccggcaatacacggggcatgccgacgccgcggattccaatctcgcgtttcgcacggcactcgagcagggcgcgcaggggttgtccgtggcattcgacctggcaacgcagcggggctacgactcggactgcgccgaggcgcgggccgacgtcggcttggccggcgtcgcgatcgatacggtcgaggacatggtgcggctgttcgacggcattgcgctcgacgcgacgaccgtgtcgatgacgatgaatggcgcggtcctgccgatcatggcggcgttcgtcgtggccgccgaggagcagggcgtgccgcccgagcggatcggcgggacgattcagaacgacatcctgaaggagtacatggtccgcaatacgtggatcttcgagccggagccgtcgatgcggatcgtcgccgacgtcgcgttgtggctcgcgcggcatgcgccgcgcttcaatgcgctgtcggtgtcgggatatcacttccaggaagccggcgccgatgccgtgctcgagctcgcgctgacgctgtcgaacgcgcgcgcgtacgtcgacacgctggccgcacgtggcatgcctgcggatgaagcctgctcccgtttgagctttttcttcggcgtcggcagcgatttctatacggaaatcgccaagctgcgcgcggcgcgcctgctgtgggcggagatcgcacacgcgtgcggcgcgcgttcgccccgggcgtgcgcactgcgcatgcattgccagacgtcgggctggtcgttgacggcacaggagccggaaaacaacatcgttcgcgtgacggcgcaggcgatggccgcggcgttcggcggcacgcagtcgctgcacacgaatgcgtacgatgaagcgcttgcactgccttccgcggcggcggcacgcctcgcgcgcaatacgcagctgattctgcagcatgaaacgggactgtgcgacacggtcgatccgtgggccggctcgtacatgatggagtcgctgacggacgacatcgcgacacgcgtgcgcgccgagctggccgccatcgacgcgcagggcggcgtgatcgccgcgatcgagtccggctgggtcaagcgacgcctgctgcgtgccgcggccgcgacgcaggcgcaggtcgattccgggcgccggaccgtggttggcgtgaaccgtttcgtcgcggacgaaccgactggcgaattcatggtatgcgagatcgacggccgtcacgtgcgtgccgggcaggcgcggcgaatcgcagccgtcaaggccgcgcgcgatccggcgcgggttgcgatggcgttgcagcggctggccgacgccgcgcgtgacggcaccggaaacctgctggcactggcgatcgactgcatgcgggcacgtgcgaccgtcggggagtgtacgcgcgcgctggaatcggtatggccgcggcatgtcgtggcggtggaagcggacggcgagggcgtctacggcgaacatcggcgagacgacgctgcatggcgggcggcgaaaggctgcgtcgaccggctggcgaaacgcgtgggacgcaggccgcgcatcatgatcgccaagctcggccaggacgggcacgaccgcggtgcggccgtcgtcgcaactgcgctcgaggacgccggattcgacgtcctgcgcctgccgctgtttcagcagccggcatgtgtggcggctgccgcgcaggcgtatggcgccgacatcgtgggcatttcgtcgttgtcgggtgcccacctcgaactggtcgagggctactccacgcactgacgtcgtatgacgccgcgattcaggtggtgttgggcggaatctttcccgcagcggatgcgcgacacctgaagatgaagggtgtcgcggcgacgttcgggcccggcgcaccgatcgacgctatcgccgaagcgctgtgcgcatgtatcgagcgggctcggtgtgcgcacgtggcggacggcgccagcgacgctttctcgtgcgccgcaacaagtccgcgatggaatgcgcgcgcgatttcggcgcgcaactgcacacggtattgctcgccggcgtcgtatgcgcgagcagcgatctttatcaccgcagcagataaacgtatccgaatcgcttcgttgacgcacgccggtacgccctcgtagattcgcgttttgaccgaatcagggccatgccgtgacgactaccgccatccgcgacgccgcgacgctatccgctggacatcctgccttgcggccggacggcgcggcgcagcatttcgacatcgtgccgttcgacgcgccgctcggcgccgaagtgatcggcctcgacctgtcgcaaccgctcgacgccggcgacttcgcgcgcatccatcgcgcgcatctcgatcaccacgtgctggtgtttcgcgaccagcgcatcacgccggacgagcacatcgcgttcagccgccgcttcggcccgctgcagattcacgtgctgcaccagttcgcgctggccggccacccggaagtgctgatcgtgtcgaacatcgtcgagaacggcaaaccggtcgggctcggcgatgccggccatttctggcactccgacctgtcgtacaaggaaaaaccgagcctcggctcgctgctgcacgcgcaggaactgccggcggaaggcggcgatacgctgttcgcgaacatgcatctcgcgtgggacacgctgcccgcgcacctgcgccgcgcagtcgaagggcggcgcgccgagcatacgtatctcgcgcgctatgcggaactgcaggcgcgcagccggtggcggcccaacctgtcgcccgagcagatcgcgcaggtcgcggcggtcgttcatccggtcgtgcgcacccatcctgaaaccggccgaaaggcactgttcgtcagcgagcatttcacgacgcgcatcgttggcttgcccgatgacgaaagccgcgcgctgctcgacgaactgttcgcgcacagcgtgcgcgccgagcacctgtatcggcatgcgtggcgcgaccacgacctcgtgttctgggacaaccgttcgctgatgcatctcgccgccggcacgcccgaccacctgcgccgcaagctgtaccgcacgacgatcgaaggcgatgcgcctttctgagccgcgagccgcgtcattcattcctgccccttcctgaccggagttccgatgtcgttttcgttcttgccggcgcgtcgcgcgctggcggccacgctcaccgccgcgctcgccttcgcgggtgcggtcatcccgcaagccgcgcacgcggaaggccgcatccgcatcgccgagcagttcggcgtcgtctacctgatgctgaacgtcgcgcgcgaccagcaactgatcgagaaggaagggcgcaaggctggcctcgacatcaaggtcgactgggtgcgactgtcgggcggcgcggccgtgaacgacgcgttgctgtccggcgcggtcgacgtcgcgggcgcgggcgtcggtccgctcttgaccgtgtgggatcgcacgcgcggccggcagaacgtgaagggcgtcgcgtcgctcggcaattttccgtattacctcgtgagcagcaaccccaacgtgaagacgatcgccgacctgagcgcgaaggaccgcattgcggtgccggcggtcggcgtgtcggtgcagtcgcgcgtgctgcagtacgcggccgcgaagcagtggggcgacaagcagttcgacaagctcgacgcgctgacgcaggcgattccgcatccggacgcgacggccgcgattctcgcgaacagcaacgtgattaccggtcacttcggcaatccgccgttccaggagcaggaactcgccggcaacccgaacgcgcacatcgtgctgaattcgtatgacgtgctcggcggcccgagttccgcgacggtgctgtacgcgaccgagaaattccgcgacgacaacccgaagacctaccgtgcgttcgtcgccgcactggccgacgccgcacggcagatcgcggccgatccggagcgcgcggccgacacctatattcgcgtgaacggttcgaagatcgatcgcgcgctgctgctgaagatcctgcgcaatccgcaggtgcagttcaagaccgcgccgcagaatacgctgccgctcgcgcagttcatgcatcgcaccggtgcgatccgcaacgaaccgaagtcgtggcgcgattatttcttcgacgatccggcgacggccggcggcagttgaacggcgccgatgctgtgacgccgcgatcgacgcttatgcgtcggcgcggtttcgatatgcgcaatcgatggttggtccacacggtgcccggccgtatgttgatgcttttcccgcaagagattcgatcgtgaacgccacttctccccgaacctggttgccgccgtatgcggcacgtggcggcgcgtcgccggccacgtctgccgtgcccgatacgcgcgccgacggtcgcccggccgcgaacgccgcgcaggccgccacgcacagcgaacgcctgctggcgatcgaccaggtcagcctcgaataccgcagcggcgcgcggatcgttcgcgcgacgcatcaggtgagcttcgacgtgtacggcagcgaccgcttcgtgctgctcggcccgtcggggtgcgggaagtcgacgttgctgaaggcgatcgccggcttcatcgagcccgtctcgggttcgatcgcgctcgacggccggcccgtaagcgggccggggcccgaccgcatcgtcgtgttccaggagttcgatcagttgccgccgtggaagacggtcgccgagaacgtcgcgtttccgttgcgcgtcgccgcgaagctgtcgcgcgcggaagcacgcgagcgcgcgctgcactatctcgacaaggtcggcctcggcacgtttgccgatgcctatccgcatacgctgtcgggcggcatgaagcagcgcgtcgcgattgcgagggcgctggcgatgcagccgcgcgtgctgctgatggacgagccgttcgcggcgctcgatgcgctcacgcgccgcaagatgcaggaggaactgctgcggctgtgggacgagttccgcttcacgctgctgttcgtcacgcactcgatcgaggaggcgctcgtggtcggcaaccggattctgctgctgtcgccgcatccgggccgcgtgcgcgcggagctcaacagccacgagcattcgctcgacaacgtcgataccggcgacttccgcgacaacgtcgcccggattcaccgcctgctgttcgacaccgacacaccgcacgtaccgacgaccgaggacgccgcatcatgagtacgatcgatccggccctgccgccgcggccgcccgtgcgcgacgaatacacgcgcacgctcgacgcgctgcccgacgccgaacgcgcggcgcccgcgccgctgctgcgccgcatcgccggcgcagcgtggtttcgccgcagcgtcatcgcgctcgtgctgatcgccgtctgggagatcgtcgcgcgcatcgtcgcgaacgatctgctcgtcccgaccttcggcgcgacgctggctgcgttcgtgcagggcatcgagtcgggcgaactgctcgtcaagacgggcatctcgatgtcggttctgctacgcggctatgcgctgggcgtgctgctggcgttcgcgctgacgtcgctcgcggtatcgacgcgcatcggccgcgatctgctgtcgatgctcacgtcgatgttcaatccgctgccgtccattgcgttgttgccgatcgcgctgctgtggttcgggctcggcaccggaagcctgctgttcgtgctcgtgcatgcggtgctgtggccgctcgcgctgagcatgaggccggcttcgccggcgtacccgtcacgctgaaaatggccggacgcaactacgggctcaccggcctgcgccagatcgcgctgatcctcgtgcctgccgcgctgccgtcgatcctgtcggggctgcgcgtcggctgggcattcgcgtggcgcacgctgatcgcggccgagctcgtgttcggcgcgagcgcggggcagggcgggctcggctggtacatcttccagaaccgcaacgagctgtacacggatcgcgtgttcgcgggcctcgcggccgtcatcgtgatcgggctgctggtcgagaacctcgtgttcgatacgctcgaacgcgcgaccgtgcggcgctggggcattcagcactgacgcgtcgggacgcgatcagtcccggcgcatgcgtgacgtaagctgaaatcggcttttcacgcggggcgggtgggttccaatccttgcggacggcgcgtcacatacgccgcgtagcggataccgcgtcgcgcgctgccgcgacgtgccccgatccaccggaacaagggcctaccgaatgactgcccgtgatgcgatcgattcgcgcgacgcatggcgcgacgcgcgcgggtgcactgctcgatgcggcggcaagcggagcgagacgggtcacagcttgcccggcctcgggtcgggcacgaagccgtcgcggttcggcatcttcacgcgcggcagcgtgcgcgcgtcgagccgggcgtcgccgggcacgatgccgttcaggtggaggacgtacgcagtgaccgcatagacgtcgtcagcgctcagcgattgcggcgcgttgtacggcatcgcacggcgaatgtagtcgaacagcgtcgtcgcgtacggccagtagctgccgaccgtctttttgggcttcgcgctcgcgagcgagccgatgccgccgacgagcggatcgccgacaccgccttcgccgccggcgccgtgacacatcgcgcatttgtcggcgaacacgtggccgccgcgtgcgaccgtgcccgcgccgggtggcaggccggtgccgtccggggcgacgtcgatgtcccacgcggcgagcgccgcgcgatcgactggctgtccgaggccgaagccggcgccgaacgcgcccgacgttatcgcgcagcccgccagcaggaaaacgagcaccttacgcattgcgcacctcgccgtccgtgccgacgcgccagttctgaatgccgttgtagtgatactgcgagttcaggccgcgcgcggcgacgagcgcgtcgcgggtcggttgcacgtagccggtttcgtcggttgcccggctttgcaggtcggccggctcgccgcgccatatccagtcggcctcgaagcgcgtcaatgcgcggtcgcgtacgtcgccggcgagccgtgccggccgccacgtgcgaccgccgtcggtcgacacgtcgacggcgcgaattcggccacggcccgaccacgcgtagccgctgatcgggtaatagccgtgcgcggcgagccggtgcccggccgatggccgcgtgatgaccgacttcgcgtccatctcgaacacgaactggcgcgcgcagccgtcgggcagcagattcgtatatttcgacgtttcctcgcgcgtcatctccggcgcgcgcaccagtttcagccgtcgcagccacttgatgttcgtattgccttcgaaacccggcacgatcagccgcaccgggtagccgttctccgggcgcagccgttcgccgttctgcgcatagacgaccagcgcgcgctcgaggatccggtcgagcggcaggctgcgcgtcatcgccgcgccgtccgcgccttcggcgagcagccagcgtgcgtcggcatcgacgcccgtttcatcgagcagcgtcgacagccggacgccggtccattcgcagcacgacagcaacccgtgcgtgaactgaacgggcagcccgctcgggccgttccattcgctgcccgtgttgcccgagcattcgaggaagtggatccgcgattcggacggaaaacgcagcaggtcgtcgatcgtgaagacgcgcggctcgtgcacgaggccgtgcacgacgacgcgatggcgctgcgcatcgatatccggcacgcccgcgtgatgacgctcgtagacgagcccgttcggcgtgatgtcgccgaacaggtcggcgagcggcgtcatcgacgagccggagccgggcagcgcgggcgtgcgggcgctgcgacggatcacgtcgcgctcgtgctgccccggcgcgccgtacggtggcgacagcagcggcgcaccgggcgcgcgtgtccacggaggcacgtcgagcggctggctcgcgagcgcgccgccggtgggcagcatcgcggccgcccagccgccggcgagctggcgcagcgccgcgcgccggccggagcgcggtgctcggggaggaaaacgggaatcggtcatggtcgagcgcgtgtagcacgcgggagccgcgcggggaaacgatgattttcggcaaccgggcacggcgcggcaaacaacgattcccgctttgcttatcgcgactatttcgcgggcgtacaacgcatggccagtcgaagcgctgagttcagacggaacgctctccgcctcgatgctcgccaccaatgccgcctgccgaacccggcgtgatgttatccggggcgccaaccaaaaacttgacgttgagagcacatgctcctattcttcgtctcaagggagcatatgctcccactttcgaacggagcgaaacgatgaacgagcctgagattcttgtgagcggtgcaaccggacgcaccggaggtatggcgatcgacgaactgctcaagatgcacaaacgcgtacgtgcctacgtgcgcaccgatgacgatcgggcggccgccctgaggcagcgcggcgtcgatgtcgcgatcggcgacttcaccggcatcgacgacattcgggcagcgatggaaggcatccgatcggcgtatttccttcatccgatcgcgccggggatcatcggggccgcagcctatttcgcacaggcggcaaaggaagcgggggtcacggcgatcgtcaacatgtcgcagatttccgcgcgtcgggcgtcgctgagccacgcggcacaggatcactgggtctccgagcaggtcttcgattggtcgggcgtcgcgacgacgcatttgcgcccgaccttctttgccgactggctcgtctatccgcattttgcgcgggagatatgggccacgaagaagatcgaatttccgtttggcaacggccgtcacgcgcccatcgccagcgacgaccagggacgcgtgatcgcccacctcctcgccaaacccgaaggccacgagggcaagacctacacgctgcacggccccgtcgagatgaaccacgtcgagatcgcagaggcgatgagcgaggttctcggcgcccggatcgaatacgcgccgacttccatcgaggaattccggatcaagatggagaccctttacaagtttccgccgttcctcacgcagcatctggtcgaagtcgcgcagaactaccgagacggaatcttctcgggcaccaacgacgccgtcgagaagatcaccggaacgccgccgctgtcggtccagcagttcgtcgagaaatatcgggccgcattcgtgtgaacacgtccctgaaacgaatcgaggggtttgaacatgtcacccatccagcctgatcgtcacccgtttctcgatgatctgacggccgatgccgaactggtcagctcggtgttgcgcacgcccgtgaccgggcgcgacgaaatccggctcgccgtcgacgccgtcgggacctttacgtctcgcagacgcccacgtttgttcaggccgtcggctcacggctctttctcgaatacgaggccgtactgacgagcggcgagacgctgagcgcggtcgtggtcgtcgatcgcaatgccgacggctcggtgccgcgagtcagcgtgcgaatgagcccgcttggcgccgtactgacgctcgcgacccatctgcgggagtcgctttcgaagcagttgccggagcacgtctttctttgagccaggcacccgcgtgctcgtggcgggcgtcgacacgcccccggcacgcggcttttgaaacaggagcttgtcatggatatcaagaacgccaccgtcttcatcaccggtgccaatcgcggcctgggcctcgcttttgcacgcgaggcgctgcggcgcggggcggcgaaagtgtacgccggtatgcgcaacacgagcggtttcgacgagccgggcatcgtgccggtcaggatcgatgtcacggatccggcgtcgatcgccgaggccgcgaaacgggcggccgacacgaccctgctgatcaacaacgcgggcattgccgcgctgatcgacgggcctttggcggccgacgtgcaagcgcagtccgcccgcttgttcgataccaactactacggcgtggtgcgcgtcacgcaggccttcgaacagatcttcgcggcccagccgcatgccgcgatcatcaacgtgctttccgacatcgtgtggctcccgcggccgaatctgacgccgtatgccgcgtcgaaagccgccgcctggagctacacgaaccagcttcgctttcacctgcgcgagcgcggcatccaggttctcggcttgcacgtcgggttcgtggataccgatctgaccaacggcatcgacgtgcccaaggccagtcccggtgacgtcgtacgacggacctacgacgcgctcgtcgccggcaagagcgaggtcatggccgacgaggggaccgcggtgctgaagagcacgcttgcggccgagatacccggctacatcacgccgccggccgggctttgaacaccgcggtcgacacgagccggattcggcggcgagacacgaggtgcgcggatcgtgtgccagcgttgtcgctcccggctatcatcgatggatacgaccatacctttgcgcgacgcgtgcgtagcgttcgcgcaaggaaccgaaatcaggagtgcacccgatgttgcccgtcaaccagccgcttggcatcgatcaatgcaactgcttcgccgtaaggaaggcgagcaggcagatctcccgactctacgatagtcatctcgagccctcgggcttgcgcatcacgcaattcctcacgctggccgccctgcgcgaagtgggaagtacgccggtcaacgcccttgccgaacggctcgatatcgaacgaacggcgatggggaagatggttggcttcctggagcgcgacggcttcgtcacgatcaagccgtcgcccaccgacggccgcagccgcctcgtcgaactcaccgaggagggacggcgcctgcacgaaagagcctcccgctctggcaggaagcgcaacgggagttcgagcaactgaacggtgtggccaatgtgacggcgttgcgagaagggttgagaggagtgcagatcggcgacgtgtcgatgcgctcgtcgcaagactgagtagtcattcgacgaagggcgatgaaatccgctgtcgttatcgctggccggcatcgcgcagcagcccgaggcgcacgaggctttcggccgtggcgacaatggcgtcctcgcgcgggcggggcgaccagccgagcaagctgatggccttctggctggtggcgttcaggttgcggccgagcagcggcagcgatcctcgcagcgcaggatccctgagtgcgccgatgcgcaccagccagtcgggcagcacccgggtggacacatggcgcgcggcatccccatgcgcgccttgagcacctgcgcgacttcggcgagccacatgctttcgccggcaatggcaatgaagcgctctccgctcgcggcgtcgtgggtcatcgcccgcacatgcaggtcggcgacgtcgcgcacgtcgacgaagccggaattgatgcgcggattgccgggctggccgttcagcatgcccctgatcaggcggatggagtgcgaatagtcgtcgccgagcacgggcccgacaaccgtcaccgggttgatcgcggacagttgcatgccgcgtccttctcgcgcgatgaagtcccatgccgcgcgttccgacaacgtcttcgacttctgataaggccagacatcggcggccgtcaggttgctccagtcggtctcgtcgaaggggcggctcattggcccgtgtccggcgcagatcgcaccgaaagcggaggtcagcacgacgcgctttgcacccgcgtcccgcgccgcacgcagcacgcgcagcgtgcctgccacggcgggcttgacccaatcgtcttcactcgtctgcgtgccggtgggcgtgggcgacgcgccatgcacgacgtaggcgcagccggcggttgcctgttgccagccgtcgtcggcgaggagatccgcctcgacgaatgacaggcgatctccgggttctgcgccgcctctttcgagctgggcgcgcacctgcgtctcgcgcgtgagcgagcggacggtggttcgtacctgatagccgcgatgcagcagcgccaggatgcagtgttgtgcaatgaagccggtgccgcccgttacgagaaccgattcgaggctggatgtgctgttcatgtcgttgaatgtcagggacgaagaaccggaaggttaagggccggtctgccgcgtgttaatgctttatagtgcgatttacttgcgcgacagtacgatgatgagtgacgaccccttctccgacatcctgagactcgcgaacgccgaatcgctggcaacgggaggcttctcggccggcggcgcttgggccattcgctttccggcacccgacaagatcaaattcttcgcggtggtgaagggcacgtgctgggtctccatcgacggagaggaaacgccaatccgcttcgcaggcggggatgtcggtctgctgacggcaaaacggtccttcgttctcgcgagcgaccctggcgttccacctgtcgatgcgatgacgttgttctcgggcgcgggcaagtcggcggtgaaactgggtgacggcgatgacttcgcccacatcggtggacacgtcctgctcgatccggtaaccggcaacttgctgtcggacgtactgccgccctggattcacgtaccggccgcatcgccgcaggccgtgaaggtgcgctggcttctcgagcaactcgtggaagagcgagcggccgatctgcccggcgcgcagctcgtctcggcccagctttcgcaactgcttttcattcagatactgcgcgcccatctgaacacgtccgcgcccctggcgggatggttgcgcgcgttgagcaacccacgcatcgcacccgcactgcgactgatgcacggcgatcccgcacgcgcatggcatctggacgagcttgccgccgcgtgcgcgatgtcacgaaccacgttcgctgcgcacttcagggcgagcgccggcgtcgcgccgctgacctatctcggccagtggcgcatgcgggttgcggagcgccgtttgcgcgacgagcgcattccggtcgccctgcttgcacaatcgctcggctattcgtccgaaagcgcattcagtaacgcgttcaagcgcatgtccgacatgcgccgacggcctatcgtcatatcgcgcgaacggctgccgaaaacgtcggaagtgaacgtggcggcgatcgcgtggaagccggggctaccggttcgacgccgtagccggctgatggcggagggtcagcgggaacgggcaaagctcatgcgagcgcgacgagcggcggcgcggcacgcgcgccggccagcgtcggcagcgcatcgagcagcgacgcggtgtacgggtgcgacggcgcgccgaacacgcgctcgaccgggccgctttcgaccacccggccgccgcgcatcacgaggatcctgtcggcgacgtgatgcacgacgccgagatcgtgcgagatgaacagcatcgcggtgccgtgctcggcctgcagatcggcaagcagatccagcacctgcgcctggatcgacacgtcgagcgcgctgacgggttcgtccgcgacgagcagcgccgggttcgacgcgaacgcgcgcgcaatcgcgacacgctgccgctgcccgccggacaattcacgcgggtagcggtcgatgcaaccggcgccgagctgcacctcgtcgagcagctgcagcacgcggcggcgacgcgcatcgccgcggacaccggccgcgtcgaggctttcgccgacgatctgtccgaccgagtagcgcgggtcgaacgagctgtacgggtcttgcgcgatcagtcgcagccgggcgcgacgcacgcggcgtgcggcttccggcacaccgctccacggctggccgtcgagcgcgacggtgccgctgtccggctcgacgagcccgagcacgatccgtgcaaccgtggacttgccggagccggattcgccgacgatgccgagcgtctcaccccgtgcgagcgtgaacgacacgccgtcgaccgcggccggcgcggcgcgatcgccgtagcgtttcgtcagcgcgtcgacggccagtaccggtgcctgcatatcgatgcgcttcggcggcagcggcacacgcgcggcggtcgcgagccggaacccgcgcgatgcggcggtgggaatcgccgccagcaattcgcgcgtgtacgggtgcgccggcgcggtcagcacgtcgcgcgccgggccctgttcgacgacctggccggcgcgcatcacgagcacgcgatcggcgagctcggcgacgaccgcgagatcgtggctgatcagcagcaccgcgtcgccggcatcgcggcgcgcgcgcagcagcgacaggatctggcgctgcacggtcatgtcgagcgcggtggtcggctcgtcggcgatcagcagcgatgcgccgcccgcgatcgcggtgccgatcagcacgcgctgccgcaagccgccggacaactggtgcggatactgcggcagccgccgctcgggatcgtcgatgccgaccgcgcgcagcaggtcggcgctgcgcgccgcgacatcgcgcccgcgcgtgttgcgcagcgcctcggcgacgaggtcgcgcacgcgccacagcggatcgagcgacaccagcgcatcctgcagcacgtagccgatccggcgcccgcgtatcgcgcgccagtcgcgttcgcgatggccgcgcgcgtcggcgccggcgatctcgaagcgttcggcgtcgatcaccgcgttgggtccgttcagcccgacgaggctgcgtgcggtgaccgacttgccggaacccgattcgccgacgagtgcgacgcattcgccggcatgcacggcgaggtcgagcggtccgacgacgggctgcgtgccgtgcgcgccgcgaaagccgatcgtcaggcgttcgatgcgaaccagcggtgcggcgcgggccggcgttgccggcgtggcggatgcggtcgtgctcatgctgcctccctgcgttcgaagcgcgcctgccagtagccgccgagcgcattcacggcgatcacggccgcggtgatcgcgacgccgggccacaccgcgatccaccacgcgttgtacagatagttgcggccctcggcgagcatcagcccccattcggcggcgggcggctgcggccccatgcccaggaagctcagtcccgacgtgccgatgatcgcggtgccgagcccgatcgtcgcgagcaccggcacctgcgcgatcgcatgcggcagcacgtgccgccagaccagcaccgccggcgcgaggccgagcgtgcgcgcgtgctcgacgtagccggaagccgcgacgacgaaggtttgcgcccgcaccacgcgcgcgaagcgcggcaccgacgcgacgccgagcgcgaacacgaggttcaccgcgccggggccggtgaacgagatcagcatcagcgcgagcagcaggtcggggaatgcggacacgacgtcgagcacgcgcgtgatcagctcgtcgagccagccgcgcgcaaggccggcaaacagcccgagcgcggtgccgaacagcgtcgcgacgccgatcgcggccgcgctgatcgacagcgagtagcgtgcgccgtacacgacgcgcgagaagatgtcgcggcccagctggtcggtgccgagccagtgctcggcactgctgccgagctgcgaggacagcggatcggcggccagcggatcgtagtgcgcgagccagcccggtgcgatgaccgcaatcgcgttcaacagcagatagacggcagccagcgcgaggcccggatggcggcgcagccagccggccgcggcggatgtcgccggggcgcgcaatgtgagatcgacgggagtgggcatcgaagcctccggttcaacgcggtgcgcggcgatcgcgcaggcgcggatcgatcagcaggtacagcaggtcgacggcggtgctgagcgcgacgtagatcgccgcggacaggatcgcgatcgccaggatcaccggcatgtccttcgacagcaccgcgtcgacggttaccttgccgaggcccggccggccgaacacctgctcggtgatgacggcgccgctgagcagcccgcccacgagccagccggcgagcgtgacggccggcagcgccgcgtggcgcagcgcatggcgcacgcgcagcgcgaggccgccgatgccccacgaacgcacggtgagcgcgtacggctcgtcgagcgctcgctcgatgccttgccgcagcacgcggccgatcacggcgccctgtgcgagcccgagcgacagcgcgggcaggacgagcgacgcgaagccgcgatcgccggccaccgggaacagcttcagcgtgaagctgaacacgaacagcagcatgatgccgagccagaacgacggcgtcgacgcgagcagcagctcgacgccggatgccgcgcgccccgcccagcggcgaccggccgtcagcaccgcgaggccgaccgcgaacgcgatcgtcacgacgaacgccgcgcccgtgagcttcagcgtcggccacagctggccgagcacgagcggtgcgacgtcggtgttcaggatgtacgagcggccgaactcgccgtgcagcacgcgccacaggtagtgcacgtattgcagcggcagcggttcgtcgagtccccattcccggcggatcgccgcttcgatctccggcgtgctcagctgctcgccgatcaggatgccgacgatgtcgcccggtgcgagatgcacggccgcgaacgacagcgtgaccgcggcccacagtacgagcgcgccggtcgcgagccgcgtcgtgaccggcgaatgcagccagcggcgccagggggccggcgagcgtgcggccggcagcgcgtccgggacggggacgggagcggaaggcgaagggttcatgtgcgatatctcctgtcggtttggcgcggcgtgcggggcaacgcgctcgacgcgcccgcctacttcttgacccacacgtcgtacgggttctcgggcatctgcgcgaacgagcggaagcgcagccctggacggccttcgcggcggcgatctggtcttcgggctcgtacagcggcaccgcgtacgcctgctcgttgatcgcgaagtgctgcagctcgccgtacagcttcttgcgttccgcgatgttctgcgtgcgtgcggccgcctgcagccagtgcgtcagctcgggcgctgccgcacggctgtagttcaacgcgccaccgcgatcgacgggcaggtagtggccttcgatgtcgatgccgtccggcggtgtgttcgaattcgcgatcgagccgaacttgccgctcttgcgcgcttcgacgtacgtgccgtcgtcgacgtactggatcttcaggtcgacgccgagtcgctgccgcgcctgcgcctgcagtgcctgcagcagcacgtcgcgctggtcgcgcaccgttgcctgcgcctggatcaccgcgatcgtcagccgttcgccgctcttcgtgcggtaaccgccgctgtcgcggacgttccagccggcttcgtccagcaactggttcgcgagcttcgggttgttgccgtaagtcttttcgatcgacgcgacatagagcggatcgatcggcgacgtgacgccccatgcacgcgtgcgctcgccgcggtagatcgactgcacgatgcccgttatgtcgaggccttccagcagcgcccggcgcaccttcacatcctgcgtgggaccgtagccgacgttcaggaacaacgagtagggcgtgccggtgttgagcgcgcggcggtaggtgaaatcggcgttcttgcggatcagcgcggcgtcgttgccggacacgccttcgatcacgtcgacctggcctgacagcagcgcgccggtgcgcacggacgattcgggcaggaaccggtagacgatccggtccaggtacgcggggccctggtggcccgccgtcggcggcgcccagcgatagtcggggtttttcgcgaattcgatttcctgccccttgacgtagcggcgcaggatgaacgggccggtgcccgcgatgtcggggccgcccgatttcaggctcggtcggtcgaacgcgttcggcgacagcagcggcagccggccggcgaatgtcaggaacggcgcatacggcgcatcgagcgtgatcgcgaccgtgtgctcgtccggtgtcttcacgtccgcgacgtgcgagatcagtcgtgcgagctggctgccggcggagtacgacagttcgcgcgcgttcaggaaattgcgggccacggccttcgcgtcgaacggcgcgccgtcggtgaacttcacgccgtcgcgcagcgtgaacgtatacgtcttgccgtcggcggagaccttgtagccggtcgcgagccacggcacgtagctgccgtccggcttctgtgcgagcaggctttcgtatgcgttgcgcaggagcagctcgaccttgtcctggccgttcagttgcgggttcagcgtgcgcggctccgtttcgacgccccaggtcagcgcgcctccggagacgggcgtgccctgtgcgaacgccgcatgcgggaacgcgagcgcgaccagcagcgcggccgaggcggtacggcgcgaagcgcggagagcggaatccggaaatgcgaatgtcatgcgtggcagcctttcacgaggtgggtagcaggggatgcggtgcgcgaagcccggaggagggggcgtcacgcgtttgcgtggagcggcacgtcgtgcgcggtggcatcgtccgccgccggatcacgatagagctccgggagcaggattttccgcagccagacgagcggcgtgccgagcgcattcgtcgagcgatcgaacggcaggtagccgttacgttcgtagtacggctgcagccacggatggttggtcgcggtcgcgagataggtcgcgggcgccttcacctgcgcggccaggaaccgcgattcgacgtgctcgatcagtgcgtgcccgaaccgctgccgcttgaacgcgggcgcgaccgcgaaccagtggaggaacggatacggcatgcggtggcgttcgccggatacccatggaaagcgcacggtcagcgtggccgcgagggccagtcggccttccggtgtcgtgtgttcgagcacgaacgtggtttcgcgcgcaacggtttgcgcgacgcgctcgatcggcgagcgcgtgatcgtgaaaagcacgccctgcggcacgagcggcgcatacgcatcctgcagcagcgcgtaaagggccggcacgtcgtccgcgccggcgatgcggatcgtatcggtcatcgcgcggtgccctcgaagtccggttgcggcgtcgcggcgcgctcgcgcgattcacgcgcatcgggccggtaccgcgacgccgccgcgccgtgctcgtcggccgacgcgcctaccagcagccgcagcgacgcaatacgcggtgcggcatcggcgagcggcgtatcgatgacgaattcgtcaatcccgtggcggcgatgcaatacgcgcagttcgtgcagcacgtcgtcgcgcgtgccgtgcacgatccgcgtttcgcgcggatcgatgcgatgcgggccgccgcctgcctgccggatataggcgtgcgcctgatcgaggctgccgacgttgacggcaggcgtgttgcccacctgcacgcgaaagccctgatgtccgcttgccagttgcgcggccgcgtcgcgggttgccgcgacgatcgcggagaccgcgagcagcggcgtgcggccgccggatgcgctgcggtatgcatcgaacgcgcgttccagatcggtcggtgaggcgttcaaatgcgacgcgtagacgaacgcccagccgagccgcgccgcgagcgcggcgctttccgcactggcgccgagcaggaatggttgtgcgggctcgggcgggcgcggcgtcgcatgcagcgtggcgtcatcctgcccagtcgtatcggcagccgtggctgcgccctgaagatgacgattcagttcgtcggccagatcggcgaacgacgcgcgccgcgcgggatcgtagccggcctgcagcgcgcgcgtcgacagcggcaggccgcccagcgccttgccgataccgagatcgacgcggcccggcgccagcgacgcgagcaggttgaagttttccgcgatcttgtacggactgtagtgctgcagcatcacgccgcccgagccgacgcgaatgcgccgcgtatgcgcgagcacgtgcgcgatcaggatctccggcgacgggcacgcgagcgcggcggtgttgtgatgttcggcgagccagtagcggtgatagccggcggcatcggcgaagcgcgcgagcgacacgctgcgcgcaagcgcgtcggcggccgtttctccaggcgcgaccgggctcttgtcgagcacgctcaagcggaacggcaacgcggtcgaagcggacgaatcggagtcggagcggatggcgtcgaacgtcatgatgaagcgatcggcgcgggtcgaaacggcctgatcaacgggtttggcatgccgaattattttgcggcgccgttcgcacggtcaaacaatcaagaagaatatcgaaagccgaaaatattcgttccggccgaccgggggcttgcattatggtcgttgactgcgcgtcgtctcgcggcgtgtgcccggcgcctgccgggcgatgcggggccacgatgccgacatgaagtgtccgatcgaacggaatcaagaggaatacagatgaatgacaaaagcgtactgcgtgagacgcgaaccctcgttacgcgccatcgcgcgacgaacggagccgtgtcatgagcggcgcacgtagacggttgaagacgctcgtcggcgcggcgagcgtgctgtacgcacccggcgacgcggatgtcgtgcacggtgtgcgacgtgcggcgtcgctcgcacggaaggcggaagccgagaagatcaccggtctctttaccgccgacctgttgcaggccgattcggccggcctcgccggcacgaccggcagccaggagccgatcgtcgcgctggcggcgctgagccagtcgacgtcggcgatcggcctcgtcgcgacggtgtcgacgacgtatcaccatccgtacaacctcgcgcggctgattggcacgctcgaccacgtgagcggcggccgtgctgcgtggaacgcggtgacgtcgtcggtcggcgaggagaatttcggcgatgcggcgttgcccgaccccgaacggcgttacgcacgtgcggccgaattcgtcgaggtcgtcaacgcgctgtttgacgcgaacgattcgggcgcgacgcggcgcgggcagggcggtggcatctcggtcgatccgcgcaagctcggcgcgatcgactatcacggcgagcacttccaggtgcaggggccactgaacgtgccgccgtcgccgcagcgtcggccagtgctgtttcaggcgggtcagtcggccagcggcgtatcgctcggcgcgaggtatgcggaggtcgtgtatacgtctcagccgacgcacgaagacgcgcgcgcattcgtcgccgagctgcatcggcaggccatcgcgttcggccgcggcgaccggctgccgctcgtgatgaactcgttccattcggtgatcggcgaatccgatgccgacgtcgcgcgacggttgcgcgacaagcatgaacgcatcgattacgaacaaggccggctgaggctcgccgacatgctcggcggcgtcgtcgacctgcgcgacctgccgctcgaccagccgttgccggggtcgctgctgccggcgatcgacagcgtgcatcgccggcgagggcgtgttgcgatcttcgtcggctatgcgcgtcagcggctgacgctgcgcgagctgatcgtccgcgcgcaggagaccggccactggttcgtcgccggcacgccggagcagctcgccgatgcgatcgaggcgcgctatcgcgcggggctcgtcgacgtgctgtcgctgcacgggctcggtcagccggaccaggaggacctgctgctcaatggcttgctgcccgaattgcgccgtcgtgcgctgctcgataccgactacgtgggcggtgatttccgcgcgaatctggagttgccggcgttgcagcgcgaaacagcggaggcgtgagcgggcgaacggtcgaacgatgcaccgtgcagcgcgttcggcggtgcgccgttccgccatatcgcgcgatcagatattcatcgaaaaataaccatttggtacacacgtcggcgcgcattacagtctcgcctcctgccggctgcgacgccggtcgttccgacgttatttcagaaattcgccacatgaatcgtttgatgcgttccagtgtccgccgtgccgcggccgcggtgtttgcggtcggcctcgtgccggcttcccatgcggcccagccgacgttgcgcgtcggaatcgacgccgaatcgtatccgccgttcttttcgaaggacgcggccggcaagtggaagggctgggaaatcgacgtgctcgatgccgcgtgcggcaaactgaacgtgcggtgcgaactcaccgacattgcgtgggacggcctgattccggcgttgcagaaccgcaagatcgacgtgatctggtcgtcgatgacgatcaccggcgaacggcagaaggcaatcgatttcagtcgcgcgtattacgaatcgccgacggtgttcgtcggcgcgaaaagcgatcggcgccgcgtcgactgcgcggtgcccgcgagcttcaagggtcgcgtgatcggcgtcgaggccggcacgaacttctcggcgttcctcgattcccgcttcaagccggatgcgcagatcaaggcgttcgacaagttcgacaacgcgctcgcggatctggtgtccggccgggtcgactacgtgcaggaaggcaagggtctgttcacggccttcctcgcgtcgcgcgacggcaaggacttcgaggtcaaggcgacgtgcgcggacaacccggtgttgggcctcggcatcggcgcgggcgtgcgccaaggcgatgcgctgcgcggcaagctgtcgaccgcgatcgcgcaactgcagcaggacggtacgtgggatgcgatcaccgcccgctatccgaacctgaagggcacgatcgagaagggccgctgacccgatggccgcggacgactcgctgctcgcgctgcttgcattcgacgacggtggatatggccgtgtgttcgcgggcgcgttcgcgctgacgttcggcgtcgcggcgtcgtcgttctgcaccggcgtgctgctcggcatcgccggcgcgctcggcaagctgtcgcgccacgcgccgctcgcatggctcgcgcggctctacacgacgctggtgcgtgcgctgcccgagctgttgtgcctgctgctcgcgttctatgcgctcgcgcctgccgtcgaggtcgcgctgcgccgcggcggcctcgtgcccgacggcttcgcgttcccgccgttcctcgttgctgcgctgtcgctcggtttcatccagggcgcgtatctgaccgacattttccgcgcggcgctcgtcaacgtgccgatcgggagatcgaagccgcgcatgcatacgggatgacgccatggcagacgttcacgcgcatccggctgccggccgccgcgcggctcgcattgctgggtgtcggcaacgtatggctgaacgcgaccaaggacgcgtcgttcatcagcgtgctcggctcgttcacggacttgctgaaggcgagccagctcgcggccggcgcgacccgtcactatgtattcttctatctcgtcacggccgcgctgttcctgctgctgagcatcgcgtcgaccggcatcttcgcggtgctcgagcggcacgcgaaccgtggcacgaggcgcgcaaccgcatgatcttctcgctgccgttcctgctcgatacggtgatgccgaagctgctcgccgcagtgccgacgacgctcgcgctgacactttttcgggtgtggccagcgtgctgctgggcgtgccgctcgcgctcgccgccggtgcgcgccatgcgccgctgcgctggtccgcgcgcggctggatcatgctgattcgcggcacgccgctgctcgttcagctctatttgctgtactacggattcgggcaaatcgtgccgcgcgaatggatgcgcgacagctgggcatcgccgctgctgcgcgacgcgttctggtacgcgatcgtcgcattgagcgtgaacgagagcgcgtatgtcgcgacgatcctgcgcggcgcgatcgccggcgtgccggccggcgagatcgaagccgggcacgcatacggcatgacgcgcgcgcaggtgctgcgccgcatcgtcggcccgcgcgcgtggcggctcgcgctgcccgcgctcgtcggcgaggcgatcctgctgctgaaatcgaccgtcctcgcgtcgaccgtgaccgtgttcgacgtgatgggaacggccaatacgctgcgcttcgagacgttgcgcgtgtacgaaccgctggccggcgcggcgatcgtctatgtcgtactggtcgcgctgctgatccttcctgccggccgtttcgagcagcacgtcaatcgctaccttatgcgcgcgccagacgagcgcacgccagcacggcgccgccgccgcgcgtcgtcgggcgcgtgggcggcacccaactgattccttccctgataccgatttcgacgatgtccgatcctcgcccgttgctgttttccctgtatgaacaagccagtgtcggttgcggtggcgcaccaagcctgtggacccaccccgccgatgaacggctgcgcgccaatacactcgcgttctggtcgaacctcgcgcgcacggccgaacaggccgacctcgacatgctgttcttcgcggacgtgctcggcctgtacgacgtctatggcgggtcggccgatgccgcgctgcagtgggcggtcgagtcgcccgcgaacgatccgatgatgctgattccggcgctggtcgcgcagaccgagcggctcgcgttcggcgtgaccgcgagcacgacctacgagcatccgttcgcgctcgcgcgccgcttcagcacgctcgatcatctgagcaacggccggatcggctggaacatcgtgacgtcctacctgacgagcgcggcgcgcaacttcgggctcgaccggatgatcggtcacgacgaacgctatgcgcgcgccgaggagtttctcgacgtcgtctacaagctgtgggaagggagctgggcggacgacgcggtcgtcgccgacaagcacgcgccgcgctatgcgcgtggcgaccgcgtgcggccgatcgcgcacgaaggcacgcactatcgcgtgcaggggccgcacgtctgcgcgccgtcgccgcagcgctcgccggtgctgatccaggccggctggtccgggcgcggacgcgaattcgcagcgaagcacgcggaggtggtgttcgtcgcgaagtcgaatccgcacgagatccgcgcgggcctcgacgagattcgccggcaggcggctgaacgcggccggtcggcggacgacgtgaagtcgctgacggtgctgcggatcgtgacggcgcgctcgtcgagcgacgcgaaggagaaataccacctgctgcagcagcactatcaccaacacgcgcaactcgtcagctacgcgggcgacaccggcatcgacatcgaccgctatgcggacgacgaaccgcttacgacgcagacggaagggctcacgtcctacgtgatgaggcccgacggcagcggcaagccgctcaccgccggcgacgtgcggcgcaagttcgcgagcgtcacgcgcggcaccgacctgatcctcgtcggctcgcccggcgaggtcgccgatcaactcgccgagcatgcgcggcagtcgacgacgagcggctacatgctcaatccgcttatcagcccgggcacgctcgacgatttcgccgaactgatcgtgccggaattgaagaagcgcggcctgtaccggacgacggcaccggccggtactttccgttcacgcctgagcggacgggatcggttgcctgatactgcgtatggttcgtcattcagacactcggccgcggggttggtctgacctcaagcaattcggtgccggtatcttcagcgcgcaaccgacgctccggtgtcgtggaacgttcggacgacggtcggggattgatccgcttggcgggtggtgaggtgcaaatttttcgtgtactaaaacgacaagcgagggcgcgccttgatgagcgatgcaaggcgtactgaagcctggtgaagcaggctcacccgggtgtgtcctgatcattctcgcggggcacacgtttgatgcgcatcgatcagccggccttcttgggttccctttttctgtcgcggatcgcggaccagatgctgctctttctggtgccgctcgtcgtctttcagatcacgcataaagcgacgtggcccgggctcgcatttttcatcgaagcgttgccgcgattcatcgcctttcctgtctgcggtgaattgagcgaccgcgtgccgcccgttcgcgtgctgcgagcgagccagaccagtcgtgccatcgcctgcatgatcggcattgccggctatgtcgcctggagcggaatcgggtggctgatcgcgttgtccgccgtctgtggcgcactcacgagtcaggggcttgtcgctcgcgaagtgctgctgccacagatttctacgcagcagcgcttcgaaaaagtgctgtcgatacgcagcttgccgagcagttgggtgtcgtgctcgggccgatcgtcgcggcggcacctagaaatccgaacgtacggtcaacatcacgttgcgcgcatcgccgaatacgctgtaataggtgctgggcggacgaatgtagtacctgcgattgaacacgttattcaattgcaaggacgccgtcacgtgcttggtgaaacgatatcccgcttgtgcgtcgaaaaccgcatagccgccctgttcgacgccacgcgaaatccgcgtttgagcgagcatgccgcccccgatcgagaatccgcgtaacgggccttgcgagagcgtatatcgggtccacagcttgaacaaatgcttcggatccgtgccgtcggtgagatcgggcgagtcgttctcgtagtgtgcgttcagatacgtgtagccggcatagagattccagtctggcgtcggctggccagtgagttcgagttcgataccctgattgcgtgccttgcctgcggatacgtaatagaactgatgggcaggatcggcaacggcgcggttgtcgtcgttgatgcggaacagcgcggcgttcgcattcatgcggccatcgagcaggctgctttttatgcctacttcgtactgctctcccgagcgcggcggcaggcccggccccgagtacgtgccttgcgtttgcgcatcgaggaaacgcgcatagttggcataggccgtcagcgacggcacgatgtcccacagcaagccggcggacggcaggaagcgatgattgacctgtgcgttggtcgtccagtccgcgacgctcggcaacgtcgactgcgtgcggtcttgcaggaacgcctcgcggccgccgagcacgagcgtcagcggcgtggcgagcttgatacgcgcctgcgcatagacgccgtattgcacggtgcggtgattggtgccgaacgtgtacggtacgtccacggcaggtaccgcattgggatcgtagagactgtaggcgccaccgtacgggccgctcaacgcgcggtaacccgattgcgcgcccgatgtcatcacggcgtagttcgcgccgatggtcagcgtatgcgtctgcccccagaggcggaccgggccggatacattggtgtccgcgccgaaccagtcatagctcgtgcgctgccgctggtctccgaagcgcgcgaggccgtttgcggtcgcgccggggccggagtacgcgtagtaggccttggagagttcgtggcggtagaacagcgtggtcgaagattgccacgcgttttcgaaccgatgcacgaggttggcgttgacctcctgcaacgaggtgtacgcgtagttccagctcggactgaagttccgcgtatattcgctcggcacgcgcccggtgagcgcggtacgcgtgctgttcagcacgccgcccgcaccgtaatcgatgccggaaatcggcgagacctgatagccgcccgagaacgacagcgtcgtgcgcggcgtgaggtcccaatcgagcgcaccataggccatcacctccttgctgcgcgtgcgctcgatggattgcataccggtgctgcccacgagaacggcgcgtccgcgcagcgtgccgtccttgttcagcggcccggtgacgtcgatcatctggcgcacgctgccgaacgaatcgacctgtgtttccgtgccgagatggaactggtcctgagggcgcttgcgcacgagattgacgacgccgcccggctcgcccatgccatcgatcgagcctgccgggccgcgcaggatttcgacgcggtcgtacatcgccagatcgaattgcaactgatactgcaggccgctcagcgtcgggaccccatcgaattcaatgccgagctgcgagccgcgcgcgcggaagtacgcggtaccgtcgccgtagtcgatcgaactgacgccggtcacggagcgcaacgcctgctggatggtcgtgatgttctggtcgtccatccgctcgcgcgtgagcaccgagaccgagttcggcgtctccttgatcgattgcgcgacttttccgccgatggtggcccactttgcagcgtagttgccgctgccttcggttgtcgcatcggcgtcctttgtgcccaccaccgtcaaggcgggcagcatgccgccgacgggggcgggcgagccttgcgcgttcgcccacgaggaggcgaggcacagcgccgaaaaggcgagcggggcaccgctgcgtcgtcccgtcgtcacgcgccgcgcgcgcgggtggtctattctcgttgtcatggttgatcatcccgatgttgaaaaatgtcgaactgcttcctcccgccagcggcgggttgaaaatggggacgatctttatcgacgggcatctgacggcctcgtctgtcttgaatccatgcactaccgaacaatcgccgggccgacatcgtggtcgatcccgcgacccgtgacgcaattaccgccgcaacccgcgcagcatcacgagcgcgacgagccacggtccgccgagcagcgtggcgacgaggccggtcgcaatttcctgcggaaaaacgatctgccgcccgagccagtccgccgtcaccatcagcagcgcgccgagggttgcggccagataaagctgcggcacggggcggcgcgcaccggaaaaccgtgcgatatgcggcgcgatcaacccgacgaacgacaacggtccgacaatcacggtagccgccgccgttgacatggccgccagcagcagcaatgcgaagcgcgcgcgacccacgggcacgccgacgctcgccgcgacgtccgtgccgagcgcaagagcggcgagccagcgtccggtcagcggtgcaacggcgagcgtgaggagcgccagtgccgcgacgctccatgcgatgccgggcgcgacgtagtaggtggatccgatcagcagatcgacgagcacgcccgcgcgcggatcgccgcttgacatcagcgcgccgactaccgtgttgaacagcgcactgatcgacagcccgacgagcagcaggcgctcgggcgcgaatcgcgcgcgccgtccgaaccagacgagcagcaccaacgtcgcgaacgtgccggccacgcagccagccaccagcgcggcgggaacgaggcggtgaccgagaaacagcacggcgaccatgccgaacatgccgccggaacccacaccgagcacgtcgggactcgccatcggattcgcgctcatgcgttgcagcagtgttcccgcgactgccagcagagcgcccgccgccagcgccgcgacgaggtggggtacgcgccagaacagcaggctttcgatttgcgtgagcgtggcgacgctcgcgccggtggggccgcgagagaccgccagcgacagcaggcatgcgagcggcagcagcatggcccacaccagcgccatcgcacgaggcgcgcggcgatcatgccggggcccgttgcagcatgcgcatcgggccgcgagcgcaaacgcggcagcaacccgacgagcagcggcacgcccacgatcgcggtcgcgcttccggtcgcgatcacgtgtgcggaaaacaggtcggcccgcgcggccgtgcgcacgatttcatcggtgagccacagcagcgccgcgccggtgagcggtgaccacacgagccgcgcgcgcaattgccgcgcgccggccaggcgggccagcaacggtgcggccaggccgatgaagccgatgacgcccacttcggcgaccacgaacgccgtgagcgcgaccgcgacgaacaacgcggcgccgcgcacccatccgaccgcgacaccgagatggcgcgccgtcgtgtcgcctgcatcgaacagactcagcggacgatagagcagggcggcgccgcccgcgcaggcggcgagctgcatgcccagatgcagcgtcggttgccagccgttctggtcgagcgcgccgccgccccagatctgcaagcccgcaagcctgtcgaaatgcaccaccgagatcgcgagactgattgcgccgcagtacaggttcaccaccatgccgccgaggatcacgccgagcggcgacatacgttgcgcccatgccagcgcgaacacgacgagcatcgcggccgcgccgcccgcgagcgccagcgtgcttcgacccatggccaaccagccgggcatccagatcgtcgcgacagacagcgtgagatacgcgcccgggaacaccccgagcgtcatgggttcagcgagtggattgcgcagcacctgttgcatcagcgcgcccgcgagaccgagtgcggcgccgcacagcagtgtcatcgcgacgcgcggcagcaggctgtagtggacgagcaaggcccccacgtcctgcgtgtcgacggtggccgcgagcgcgtgccaaaggatgcgcccgccagtgcgcgatgcacgtccgtggcggtgaggcaggcggcgagtacggccatggcgccgaccagcgccaggcgccgatcgcttgtccgcgcgacgcgttcggccagcacgaggttacgcaaggctgcctccgccgtgctcaagtgtggcgagggcgatcgagaccgctgcggcgaagcggcgcatcgacacgagtccgccgaaggccgcgatcaccggcagtactgcgacgcgtttctcgcgcacggcaggcaacgcacgccacaacgggctctggttcagcgcggcacgcacggcggcgcgcagcggcccgatcagcagaatgtccgcgtgcgggacatcgaacaggcgttccagcgcgacggtggccgagccggttacggaggtgcgccatggcgtggaggccgcgcggctcgccgcgtcgcgaggatgggccgcattgtcgacaccgatgcgcgcgagcacgtcgtcgaacaggctacccgcgccatagacgcgaaaatgtcgctcgtcgagtgcttcggcgacgatcacggttcgcgccgggtgagccccggtgctcgcgatccgggtggccaccgacgcgaattcctgttgcgcggcggcgatcagctcggtggcggatagcggcgccccgatcgcgcgccccatcgcggatgtttcgtcgcagagcacctcgagaggccgtgcagcgctcatgtatgtgcccagcgtgagcgtcggcgcgatgcgtcggagcggcgtcatcaacgccgcatgcgccggcgtgacgatgatgagatccggcgcgagcgcgagcagcacctcgaaattcggctgatagagcaggccgacatcggcgacgccgggcggcaacggcggcgtcacgatgccgctcgcataccagtcgggcaacggaatgccgacgggcgcgcgcccgagcgcgagcagcgtttccgtcagttcccagttgagcaccacgatgcggtgcgggaaccgtgtgatcgcggcagcgacgcatggcgcggagaaccgtgtgccggagccggcgagcgcggtgagcgcgacgagcagttgccggcggcgcggattcgcgacgagcaggttcatgccggaaaccccaggcgccgcccgctgaccggatcggcgctcacgcgcatcggcacgccgtagatcgattcgaggtggacagggtccatgatgtcggcggcgcgctcgcgcatcagcagacggccctcgcgcagcgcaacgatgcggtcgcagaaccgcgcggccatgttcacgtcgtgcaggacgacgacggcgctcatcgcgctcgtcgcgcagagcgtgcgcacgagttcgagcacggagagctgatggttgaggtcgagcgccgacgtcggttcgtcgagcagcatgcagcggcagtcctgtgcgaccagcatcgccagccatgcacgctgacgctcgccgcccgacagtacgtcgacggggcgatcggcgtgacggagcacatcggctgcacgcatcgcgcgctcgacgtgctcggcgtcttcgtccccgaagcgtccgagcgcgccatgccacggataacgcccgagggcgaccagttcgtgcacggtcatgccgtcggtgggcggcgtctgctgcggtagatacgcgacctggcgcgcgaactggcgtgcgccccagccggcgagcggcttgcccgcgtagcgaatcgtgccggcagtgggggcgagctgacgggcgagcaatttgacgagcgtggatttgcccgaaccgttgtgcccgaccagcccggtcacgcatgcgggttcgatcgcgagagtgatcgattgcagcaggggacggccgctggcgacgtacgacacgcgttcgagcgagaacgtcgcggtatcgccggtgtcgccgcatgcggagcgggctgcttcgtcgcgcacgatatggctcatgccgcgctcgccatgtcgttgccgcccgtacgccgcgcattgtccgcgctgtccgtgtccgcgctaatcgcggcgatgcgcccgttctcgagtttgatgagacggtcggcgagatcgaagtagcgatcgtcgtgcgtgatgaccagcacggtcttgccgttcgtcttcagcgcgggcaacagcgtgcgatagaacacgtccttgaaggccgggtcctgatcggccgcccattcgtcgaagacatagaacggtcgatcctccaggaatgcgaccagcagcgcgaggcgtttgcgctgaccttgcgaaagggcgagcgtggagaacgtgccgcgctcgatgcgcaccttgtggtcgagttgcagtgcgacgagcaacgtacgcgccatcccttcgcgttcgccggccaggccgagcagcgaatcgaacagatgaaaatcgctgaagaccaccgagaaacgctgtcgatacgcggcacgcgtcgtgtcgtccacggcgacgccgtcgacgagcagacggccgcgctcgggcgcgtaaaggccgacgagcagcttcgcgagcgtggtcttgccgctgccgttgccaccgacgagatacacgagctctccggcgtcgaacgtcagatcgatgggcccgagcgtgaacaggccgtcgtcgctttcgcgcacatagcgatgttcgacaccttcgaacgcgatgcgcgagaatccttcggccggggctggggcggaatcggcgtgattgcctggttcggcaggcagcgccgcttcgagcgcgccgatgcgctcgaacgcaacgcgtgccgagttgagcgacggtagcgccgcgagcagcccttcgacgggcatgatcagatagaggaacacgagcgcgtagcccgacatgacgtgtgcgtcggcgccgaacagatgcgcgagcacgaaagtcgtcaggccgacgaaaccgaacagcagcaaattgccccagcttgccgcgagcgcgtgcagcacatagccgcgcgtgcgctgcacgcgcaccgcctccacgtgcggtgcgagctcgctgccgacgaacgcgtccgcgcgtgcgcgatgcagcttgagttccttggcgccgtcgaacaacgcacgaaactggttcagcagcgtgtcctcgcggtcgcgcgatgcgcgcagatgacgcagcgcacgggcgctcaccagctgcgtgccgagcgtgccggccccgagcacacccagcgcgaccgcaaggatcggcagcgagagcatgccgaggtacgtgagacagccgacgatcacggcgccctgcatcgcaatggagggcaggctcacgaagaacacgacgatgctgtcgagatcctgggtcagcgcgcccaccgcgcgggccgcgccgcaccgctccagatcgcggaacgacgcggcggtaatgcgtccgatcgtctgcatgcgcagttgagccttgacgcgctgaccgagatacatgaatagcgcctgcgagccgatgcgcgtcacgagcaccagcgcggcaagcagtacgaagcgcatgcccaggtgcatcagctgtgcgcccgacgcttgcaacgcctgattgatgagtgccacgagcgccgcattcgcgaagccgctcgcgagactcgcgaatagcgcgaccggcagcaaccagcgtgagtagcggagcaatgaggcaatgagaggcataagtcgtcgaaggtcgtgcggacgtgctggttgcacgtgttgtgtctcagaaataagaatgagacgtattaaacatggcgagcgggatttggccgtaaccattgatgggtaaggagattaatgcctcccgcagccgaaaggtagacaggtgatatcgatttttgacagaatttggtgaatttgaaatatcatggcgcacttcctttcgaacgtctccgatgaaggcttttctgctcaagcgatatccgctggcgcgggtgccgctgccgcgccaggtggccgcgaccctcgtgaactaccgtcaaggcgaacgcgtggcttggcatcagcatcgccatggccagctggtctttgcagcgaagggcgtcgtccgcgtgctcacaccggcccgtacatggacgctcccgccgtcgcgggcggtgtggctgccgtcggacgtcgatcacgaactgcacgcggtgggtgacaccgcgctatgcagcgtctatgtggaacccgaagtgtttccgtggccttgggaggagccggcggtcatcgccgtgtcggcgttgctgcgggaactcgcgctcacggtggtcgacggggcggatacctatacggccacgagccgtgccgggctcgccgcgtcgttgctgatgaaagtgctcgcggaaacgccgagcctcgccgagccgggtgtgcccttgccgcgcgacgagcgcctgctcaagctgtgcgagcacatgatgaacgaccccgcgagcgatctcacgctggacttctggggcgagcaattcggcgcgagcggccgtacactcgcgcgccggctgcatgccgagacggggctgacgttcgtggcctggcggcagcagatgcgcgtcgcggaagcgatcacgcgcctcgcgctcggccagtcggttgcgcaggtggcaaagatctcgggtatcgcagcgcgagcgcgttcatcgtcatgttccgacggatcacgggcgaatcgccgcagcgatatctcgcagcgagctgaacaggcacgattcgggccggcccggcgacgcagcgccccggacacatgcggcccgatcgggattcctcgccgcgcgcttatccccgcccgacgaacggcatggccgtcgccatgatcgtcatgttcaggatgttggtgtccagcggcaggttcgccatctggacgatcgcgttcgcgacgtgcgtcacgtccatgcgcgcttcgggcgcgaggctgccgtcggcttgcgggacgccttgcgtcattcgttccgtcagcgacgtcgcggcgttgccgatgtcgatctggccgcacgcgatgttgtaccgtcggccgtcgagggccagcgccttggtgattccggtcaccgcatgcttggtggccgtgtacgcgatcgtatcggggcgcggcgcatgcgccgagatcgagccgttgttgatgattcggccgccctgcggcgtttgcgctttcatcacgcgccatgcggcccgcgcgcacagaaagacgccggtcaggttcgtcgcgacgacgctgttccacagatcgaattcatattcgtcgagggaaaccgcgggcgcgttgcggccggcattgttgaacagcacgtcgagccggccgaactgccgcgcgatctgcgcaaacgcgtggtcgaccgatgcttcgtcggtgacgtccgcaggaaacacgtgcgcgtcgccgccggcggcgcggatcgcgtcctgcgtttcgcgcaacgaggcctccgtgcgaccgagcagcgcgacggtgaatcccgcctgggcgagcgcgacggccgctgcgcgaccgatgccggagccggcgccggtgacggctgcgaatttcttcgagacagacatggcttgatttcctgctggttgaaagagggcgaggcggccgatgaccgggatcatcgccgcattcggcaatgtagtcgaaatgcgcggtgcgcatgtccgggcgacatcgcaacgcacgttcggctgactacttcgtccggccgggcgcggcctttcgtgcccgcgtgccggtctgcgcaaacagatcgaccacgacgtcgcgcagccaccggttccctcgtcctggttgacccgtgcatgccagagcatgtgaatcggcgtccccggcagcgcgacgggcagtgcgcgccagcccagtgaaaacggtgcggcgagctgctgcgcgagatgctcgggcaccgtcgcgatcaggtcggtgcgctgcaggatgtagccgacgctcatgaaatgcggcaccgtcagccgcacctggcgcgccacgcggcggcgcctcagccattcgtccacctgcccgtgaccggtgccggccgacaccacgaccagatgttcggcattgcgccacgcgtcgaccgtcagcggcgcgtcctcgagcggatgcccccgccggaacaggcacacataacgctgatcgaacagcctgcgctgatagaagccgcccttgagctgcggcagcaggccgatcgcgagatcgacgcggccgtcggccatttcgtcgccgaggttgatgctcgtgttgcgcacggtattgagcgcgatgcccggcgccgcttgcgacaggtgttcgagcagcgcgggcaggaacacgacttcgccgatgtcggtcatgccgatcgtcagcgtgcgcgtggcgcgcagcggatcgaaaccggtctcgggattgagcgcggcgtgcagggtcgcgagcgcgtgcgacacgggttccgccaggcgcagcgcgaacggcgtcggcaccacgccgcccggcccgcgcacgaacagcggatcgccgagccggcggcgcagcttcgcgagcgcgttgctcacgcccggctggctcatgttcatctgctcggcgacgctcgacacgcgccgttcctgcatcagccgctggaaaagcagcagcaggttgagatcgatatcgctcagttccatgggttttgcctcgcccgcttcattgcatccggtgatgatgcagattcatttcattttattgtggaatgaaagtcggctcccgagaataccggtacggcccatgcaatcggcatggccgctgcgcacgtcgcacaccccacatcggaatatcggagacaccttcatcatgcagacgaacctgaagattgcgatcgtcggcgccgggatcggcgggctgacgctcgcgctcgcgctgcgcgagcacggcatcgacgctcagatctacgaacagacggaggtgctgcgcgaagtcggcgcggccgtcgcgctgtcggccaatgcgacgcgcttctacgaacgcatgggcctgcgtgcggacttcgacgcggtgtgcgcggacattccggggctcgtctatcgcgacggccgcagcggtgcggtgatcggccatcatcgcggcgagcccgactatcgccggcaattcggcggcgcgtactggggcgtgcatcgcgcggatctgcaggccctgctgtcgaaggcggtcggcctcgacagcatccatctcggccaccggttgaccgatctcgtgcagcacgccgatcgcgtcacgctggcgttcgacaacggcgtgcgcatcgacgccgatctcgtgatcggcgcggacggcgcgcgctcgatcacgcggcgctggatgctcggctacgacgatgcgctgtattcgggctgttcggggtttcgcggcgtggtgccggccgcgcggctgagcctgctgcccgatcccgaaacgctgcagtactggatcgggccgcacgggcacctgctgcactatccgatcggcgacggcggcgaccagaatttcctgctggtcgagcgtcatccgtcaccgtggccgtcgcgcgactgggtgatgccgtcggaagagggcgagcaactgcgtgtattcagggactggcatccggcggtggtgcagatgatcaccgcggtgccgatcagccagcgctggggttgttccatcggccgccgctcggccgctggagccgcgggcgcgtgacgctgatcggcgacgccgcgcatgcgctggtgccgcaccacgggcagggcgcgaaccagtcgatcgaggatgcggtggtgctggcggcgcaactggcgaaggccgggccgggcaactggcgcgaagcgcaggaagcgtacgagcggctgcgtcgcggccgcacgcgcaaggtgcagtacgcgtcgatttccgtggccgatgtgctgcacctgcccgatgggccggccgcgcaggcacgcaacgcgcgtctggccgagcgcgacagcgtgctgcatcacctggactggattcacgatttcgatgcgctcgccggggagccggacgagcggcagggcggcacgtggctttgagcccgccgtcacgcccgggcgcgccgggacggcgtgcgcggcgcatgggacgggcgccggcctgcggccggccggtcaccgtcgcgccggggaagacgggcggggtagcgcccggccgccatcacttcacgcactcgagcgcgtacttcagtcccggcgcgagcagcccgcgccatacgtcccatgtatgcccgccgtcgacgatgcgcagttcggccgggttctgcgcgcggcgcaggtgcgtgtacagcacgctcgattcggcctggatggtcaggtcgtcgtcgccggccgcgatgaacatcgggattcgccagctgcgcgcgaaatagccgcgcatcagcgccgggtagttgagttcgtgccacacgcgcgggtcgaactgccggtcgccgaacacgccgacgtagcgcgcggcggaattgagcggcggctcgttcgcgtagatcgcggggctcagcagcatcgcgccgcagaacagccccggttcgagcagcgagaagcgcagcgcgccgaacccgcccatcgacacgccgccgatcgcacggcccgcgcgctggttcgacaccgcgaagtgcgcttcgacttcgggcagcaggtcgttgaggaacgcgctctgcatcttctccttgcggtcgacgtaccagtcggtgccgccctgcggcatcacgatcacgacgggcggaatctcgcggcgctcgatcagcgtgtcggcggtggcctgcagccggccctgcgtgacccagtcgttcgcgttgccggcattgccgtgcagcaggtacatcaccgggtagcgcgcgccttccgggttgtagccgggcggcaggtagaccgtgtacgaccagtcgcgcttcagcgacgccgaccggaacgtgcgcagcacgacgctgctgcccggattgaccgcaggctcctgggcggccgacggggtcgtcgcggtctggacggccggcggcggcgcgggcgataccgccggcgcgggcggcgtggcgcgggcggtggcgatggagccggcgatcagggcgagggcgaacggaagggcgagtcggcgcatgtcgaatcgtttcaggagaggcgccggctatcgtagcagcggcgcatgacggcgcggcgcgtcatcgccgcgatcggaacggcagccgcgcgacgagcggcccgtagagtttggcgacgagatacagcaggccgatcgcgacgacgtcggcggtcagcccgagtttcacgtcgagatagccctcggtcgcctggtaaagcagcgaatcgaccgcgagcgagatgccggtgcccgcgacgaagcacagcagcccctgccggccgatcgtgccgatccacggcatcgcgtgcgcgaccttcttcatccagccgaggtggacgagcttggccgcgagccacgcgatcgcgaggaagttcgcgagccgcagcgcgccgaggttctgcttgatcgacggatcggtcgggaacggttcgatgcgcagccggtaatacgcgccggccgcgacgatcgcgagcgacacggccgtcagcagccagccctgcggcttgggcgcgagcgtctggtagacgggctggcagcgcgcgatcacgccgagcacgaacaggaactgccacgcgaacgggttgaagtcccacggcgcgccttcgacggtcggcaagaagcgcgcgacatgcggcgccgcgaaccacagcgagccgctgaacgcgagcagcagccacggctgcgtgcgtgcgagcggcagcgtgagcgggacgagcagcgcgaagaacgcgtacatcggcagcaccgacgcgaggtacggctggcggcggaacagcaggatgtcgcgcagcgcggcgagcggcttgtggagcaggccgtcgaggtcgttggtcggcatgttcgggccgtcgatcgcgaacgcgttcagcacggccgtgatcagcagcatcaggccggccgtcacgaggaacgcgcggtagatctcgaacgcgcgccggatgaagcgctggcgcgcggcggcttcgtcgtgccgctcggcgagcgagttgtacgcgatcgcggtcgcgaagccgccgaggaacacgaacacctcggctgcgtcgcacagcgcgtacgcgtgcagcgtcacgcgcgacaggatgctgccgccgatgtggtcgacgacgatgacgagcagcacgaggccgcgaaagaaatcgagctcggcgtagcggccggcccgggccggcgcggtcatcgggccgcctcccggcgcgggccgcgtgcgcggccggcacacgccgcgcatgaatcggggtgaagcatgaattcgtgaagaaatgacgaacggatgcgcattgtgccaccgatgcgccagggctcggtttacgcggatggcggcgcgtcccgccgctgccgataagccgggtcaggccgtccgcgcggcggggcagttggacgagcgcaacgttttgcgcagggttcacatgccccgatggacggacggtttgcgacgtgacaccattttgtcctcacgcggccgcacaccgcgtcgtccgccctgcgggccacacctacaacagatcgaacattcgccgggcgcgcgacgcgcccggccccggctccggagattcgtcatgaagaagcacgtcatttttaccgctgcgctggctgctttcgccgcgccggtcttcgcccagaacagcgtgacgctgtacggtgtgatcgacgaaggcttcaactacacgaacaacgtgaatgtgaatggggtcggaaagtcgaattaccagctcgcgagcggctatgcgcagggcagccgctggggcctgaagggcagcgaggatctcggcggcgggctgaaggcgatcttcacgctggaaaacggttttgacgtcaacaacggccggctcgggcagggcggccgcatgttcggccgccaggcgttcgtcgggctctccgagtcgcgtttcggcacgctgaccttcggccgccagtacgactcggtcgtcgattatctggcgccgctcacggccaacggcaactggggcggcacgctgttctcgcacccgttcgacaacgacaacacggacaactcgttccgcgtcaacaacacggtcaagtacgcgagcgccgactggaacggcctgacgttcggcggcacgtacagcttcagcaacagcaccggcttctcgaacaaccggcagtacagcctcggtgcgcagtattcgctggccgggctgcaggtcgcggctgcgtacctgcaggcgaacaacccgggtgtcggcagcgcgggcgcgatcaccgcggatgacgcgaacttcgtcgccgaccgcctgcggatcttcggcggcggcgtcaactacacgttcggcccggccacggtcggtttcgtctatacgaagacggacgtgaagaatccagtatcgacggtctacctgccggcttcgacgttcgccggcctcgggctgaccgcgacgaagttccagaacttcgagatcaacggcaagtaccagctcacgcccgacttctatctcggcgcgcagtacgtgtacacggacggcaagttcgatgccgcggccggatcgttcaagccgaagtaccacacggtcggcctgatggccgactacagcctgtcgaagcgcaccgacgtttacctgcagggcgcatggcagaaggttgccggcgacaagaccggcaccgcggccgacggcggctacgtggtcgggacggacggcccgtcggcgtcgtcgaaccagttcgcggtgcgcgccgcgatccgccacaagttctgagcgtttcgaccggccggggccgatgccccggccccagcccgcgccagcccgcccggtacgggccgccgagcgtctccgcgagccagtcgacgaagatccgcacgcgcggcgcgagatgccgcccggtcggaaacaccaccgacacgggcagcggctcggcattccattccggcagcacctcgaccagcgagccgtccgccagcagcggcccgagcccttcgcgcggcgcctggatcagcccgaggcccgcaagacagcacgcgagatacgcctgcgagctgttgaccgacacgacgctgcgcatcttgaccgcatgcagttcgcccgtatccatgtccgcatattcccagtccagctcacggcccgttcggctcgagaaatagccgaccgcgacgtggtcgggcagctcgtccggcgagcgcggcgtgccgtggcgcgccagatacgcgggcgccgcgcagttgatctgcgcgagctcgccgatgcgccgtgcgacgagcgacgtgtcggacatcgtgccgacccgcaccgcgcagtcgatgccgtcggcgacgaggtcgacgaagcggtcggtcgtgccgatcacgacgcgcaggtcggggtagcgtgcatggaaatccggtagcgccggaatcatctggttcaccgcgaagcgctccggcaggtcgacgcggatcgcgccgcgcggcgtcgcgccggcgtcctcgaacagcgtttccgcatcgtcgagatcggccagcaaccgcatgcagcgctcgtagtaggtcgcccctcggccgtcagcgcgacgcgccgcgtcgtgcgctgcagcaagcggaccttcaggtgcttttccagatactggacggcgttgctgaccgtcgggcgcggcagttgcaactgctcggccgctttcgtgaagctgccgagatgggcgacgcgcgcaaagatgcgcattgcatgcagatgatccatgcggggcgggggtgtgggcggatggacaggctccattgttaatcagcgtcgaatggtttggtggagtgtttcgcatttatcgcgcgtcgcgatgcgcccagaatccggcctgttgattcatcactcgaggaaacggacatggagatgcgtgaactgggccggtcgggcccgcgggtatcggcgctcgcgctgggctgcatggggatgtcggacttctacgggccggccgatcgcgccgagagcatcgcgacgctgcacgcggcgctcgaccacggcatcacgatgctcgacaccggcgatttctacggaatgggcgacaacgagatgctgatccgcgatgcgctgcgcggccgggcacgcgaccaggtgctgatcagcgtgaaattcggcgcgctgcgcgatccggccggcgggtttgcgggctacgacgtgcggcctgcggcgatccgcaacttcgtcgcgtactcgctgaaacggctcggcaccgactacatcgacatctaccggccggcgcgcgtcgatccggcggtgccgatcgaggagacgatcggcgcgatcgccgatctcgtgaaggccgggtacgtgcgccatgtcggcctgtcggaagccggcgtcgacacgatccgccgcgcggcggccgtcgcgccgatctccgacctgcagatcgaatattcgctgctgtcgcgcggtatcgaggccgggatcctgcccgcgtgccgtgaactcgggatcggcgtgacggcctacggcgtgctgtcgcgcgggctgctcggcgggcgctggagcacggcgcggcagggcgagcgcgatttccgcgcggcgagcccgcgcttccagggcgagaacctcgcgcacaacctcgcgctcgtcgacgcgctgcgtgccatcgccgacgagaagggcagcaatcccgcgcaggtcgcgatcgcgtgggtgctgtcgcgcggcggcgatatcgtgccgctgatcggcgcgcgcaagcgcacgcagcttcaggacgcgctgcaggcggctgagatgcaactaacggtcgatgacatcatgcgcatcgaagcggcggttcccgccggggcggctgccggtgagcgttatccggccgcgcagatggctcacctcgacagcgagcagggacggggacatttcacggggactgatcggccgggccggtagccggcgcacgcgacctgcgttgaacgaaggcgggcgtgcgccggacggcggcggcgcggtgtgcgaatgtgcgcgcgcgccggccgcgccggcgccgcgcggcaggcccgagccagcctcaggcaaagccagatggcgggcggcgcgatcggggttcaccatcggcgccgtactcaaccggacggaatgcctttcatgcacattgatacgctgacgatcgtcgcggtggttttcctgctggccggcgcggtcaagggaatgatcgggctcggcctgccgaccatcgcgatgggcttgctgacgctcgcgatgccgccgtcggccgccgcgagcctgctgctcgtgccgtcgttcatcaccaacgtatggcagttgtggctcggcccgtcgttcgggccgctgctgcgccggctgtggccgctgctcgccggtctgacgatcggcacgctgacgggcgggctgcccgcgctcgcggccggcagcacctggacgcatgcggcgctcggcgtggtgctgatcctctacgggctgtggggctcgccgccgcgcggctgcccgcgccggggcgccacgaaaatggctgtcggccgtggtcggctacctgacgggtgtcgtgacggccgcgaccggcgtgttcgtcgtgccggccgtgccgtacctgcaggcgctgcggctgtcgaaggacgacctgatccaggcgctcgggctgtcgttcaccgcgtcgacgatcgtgctcggcctgcagttgcgcgtgacgggtgcgctggagacggtcgatctcggcgtgtcggcgctcgcgctcgtgccggcgctggcgggtatggccggcgggcaatatgcacggcgcgtgatgagcgagaaggcgttcaagcgctgcttcttcgtcgggctgatcgcgctcggcgcgtacatggcggtttcggggtggcggtgagcgggcatcgccggcgagcgtgatgcccgctgtccgtgacgatcccgaagccggtcgtcgaaaccggcttcgggtgcgttcaccgggcgcgggtcaccccgctcaggccggatcggcgtacttcagcgtccacccgaatgtacgggtcgcgcccgcgccgagtgcgaacggcttcgtcgtgcatgcgaagttcgaatgcaactggccgatcggtgtcgtcgacagcggattcgtcgtgccgttcaccgtatcgaaggcggacagcgcgcagttgtcgaacccggtcgccgcataaccggtcgcggggctgttcgcgtacgtgaccgacacgccgtcgccgttggcctgcgtcgaggtgaaatccgcgaacgacgtgaagtccgtttcgaccgacaggttgccggtaagcgtgccggtgctcagcgtgtcgctgcgcgccaccgagccgtgcgcgaacgtcagcaccgtatgcacctggagatcgagatccgtcgtgtacgccgcgttcttcgatgcgagccggaacttcgcggtatcgaacgacacgatcacctgcccgttgccttgctggacattcaggttcctgtagtacgtgacgggaatgtaggtcttgccgttgtacgacacctgcggaatcagcaacgcgtagccgagatcggtcgtgccgtaggtcagcttgtcggaggacggcaccgggtagtacggcgtgaacgagttgtagtcgggcgcctggctgaggttcaggttgatcacgcgccggccgtcgcgcacggtcaccagcgccgcgctgtacggatgcgcggggtcgttcggccggttgtaccaggtgagcgtgtagcgcgggagcgcgtcgagccatgcgttgtagtcggcgtcggccatcggtgccttgccgccgaagccgagcttgttccaccacgcgttcacgtacaggtactggtgcagcaggctgaagttctcgcccatcacgcgcggcttgccgcgatacgcgtccgtgccgcgacccttgacccacatgttcaccgagggcgtcggcagcgacgggtcgtaccagaacgtgtcgaagcgatgcgccgccttcgtgatgaacgtgtatgcgacctgcttctcctggtcggacagcacgccggcgttggccgcggccgtcagcacttccatgaacgcggaatcgccgtacgggccgatcgagcggccgtagttgaagccttcgccgtcgccgttcagctgcggcaggatgaggtcgacggacttgcgcagataccccttcagttccggcgtgaaattcgcttcgttgcccatctcgaacgtgcgctcggtcacttcgccgatcagcagcgtgctgtagcggtcgaagcgcgcctggtcgtagtaggtcgtgtgcgtgttcgacgcttcgtccgagaacccgcccgacgagtcgttgcggatatggttcgtgagcgtgtacagcagcgcgtcgcgcgcacccatcgtcgcgaccgccggatcggtcttcgacgcgaacgacgggctgctccagccgagcttctggcgcagcccggcgattccgtaggacaccgcatagtagttctgcgcggtgttgagcgacgcgatgtcgatcggcgtgccggcggccgggcacgtatcgaccttgccgctcgcgtcggggccgaacatgtcgcagaaccgcagccgctgctgcagtgtcgcgagcatcgcgtcgctgaagacttcgttgagcatcccgtgcgcctgcaggttgttcagcgcgacgagatagtagtactcgccccacgacgtgttcgcatacgtatagttgccgcccgactgcgccatcatcgcggtcgtgatcttctggtaggtcgcgaggtagctcgcgtattgcggatcgttcttcgacttcatgtcgatcaggatgtacgacaggccgagcgcgagcttgccgggcagaaatttgtcgccggtgttcgtgtcgagcacgtggacgggcgtgccgtcaccgagatccatcacgacctgcgtgaagtcgggcgacttccggatcaggtcgaacagcgcgcgcatctggcccatcatcgtgatcggcgtatccgtgccggccggcacgcgcgtgtcggccgcgccgtagacgagcgcctgcagcgagttcgccgcgagcgcggaggcgggcggcgacgtcggcgtcgagttcgacggcggggacggcggatcggtgatgtcgttgccgccgcaggcactgacgaacaggacggaaagggcgctgagcgcggcgccgagcgcgaatctgctgcgcggatgcattgtgtctccagtcttgaatagtgatgagggacgggcggggtggccgtcgccgcgctcgatgcccgtgcctggccgctgccttgcaaccctgatccctgaagacggacggcctgaatcaccactcgagcgggcaagcgttctccctgcgcgggccgtggccggcgtcgcgcggatgcattggaaaacgttttccaaatttaggcatcgagcggcgtgatgtcaatgaactttcacgtcgaacgcgccgggaaaacccggatggcggggtacgaggaaatggaacgacagattggaatgccgcaaaattacggagatttctctcggtcgtgacgaggtgaagcgcgggaggtcgatgcggacgcggcgagcagagagactatccggcgacatctgcgcgccggattttgagagaaaacgttatccataaggatcgaagcgaatcgtgccatgcatcgcggcatcgaccgtgagcgacgcgcgtcacctcggcgcggtttcgccggacaggaacgcgacgaattcgcgcgtgtacttcggcagcgcgtcgaacgaccgcgcgcacagcttgaggcggcggtggctccacggatcggacagctcgacgagccgcacgtccattgtctgcatcgcacgttcggccgcatggcgcgacacgatgccgatgcccacgccgctggcgatcacgcggcagatcgcatcgaagctcttcaactgcacgcggtagcggatccgcttgccgagcgcgcgcgcctggtcggcgagatgcacctgcagtgcgctgccgtcggtgaggccgatgaagtcggcgtcggcgatcgtgtcgaacgcgaccttgtcgtgtgacgcgagcggatgcgcggccggcacgacgacgatcagccagtcctcgcggaacggcttctgttcgagcccgccgagcccgaccgaatcggcgacgatgccgacctcggccgtcttgttgcggatcgcgtgcacgatctcctggctcgagcgctcctcgacgctgatcgacagcttcggatgatgcggcaggtagtcggccagcgcatcgggcaggtattcgctcagcgacgccgtgttgcacagcagccggacgtgcccgcgcagccctggccgtattgctgcagttcgccgcgcatgtggtcgatctgctgcagcacggtgcgcgcgtggtgttcgagcgcgcggcctgcgtcggtggcctgcgcgcccgacttggtccggtgcagcagcggtacgccgagctcgtcctccatgccgcggatgcgctcgctcgcggcctgcagcgtgatgtgggtccgctcggcgccgctcgtgatcgtgccggcctcgcagatgttcaggaagagccgcaggtcggtcaggtcgaagcgcatgatgggtgggggcgatcgcgttggaatggccgataagttagcagggaactgcggccggggtctcaggcttagcctgaggcccgattcgccggttccgtattttcggggcgcgatcgatgacggatcatggccgcacatcaaccgggagcctgtcatgcggatcgatccgtcgtggggcgtgtcgttcaagatcgcgctgcacgtgctgttcctgtgcatcggcatcgcgtgggcctgttccgaactcgccgcgtggctgcgttgagcgtcgcggcgcgcagcagtggcaggctgcgacgcctatcaaaacgagttcgtcatagttttgcgaaacgaaaattcttccgttttcgcgcgaaaaaccatcaagtttttccgaatcggaccgtattaccggtagcgaatgccggccggcatccggttcgtgatcgtttgtcatcattgttttcatccggttacacgtcggccgttccgtttttgagatgcttgaaagattgtcaaaccggagtcggatcgtccatgaaatcgcacgagattcaccgtcacgcggcgtggctgccgggcctggccgccgtgctcgtcatggccggttgtgcaagcacgcagtccgttccgccgagcgacacgctggcggcacagtcgttaccgtcgagcccgccggccgttgcgccggcggccgccacccgcctcccgcgccgattctcgttgcgcagaagtacgtcgtgaagcgcggcgacacgctgacgggcatcgcgtccgcgaacggctgcagcattgccgacctgcgcacctggaacaagctcggcgcgaacggcaggctgcgcatggggcaggtgctgcgcatcgtcaggcagcagccgttgccgccgccgggcgcggccggcgtgcaggtggccgcctcgtcggctgcgagcaatggcgcggggagcagccccgcatcggcgcaggccaccgcgtcgaccgcgagcgaccgtcaggtcgtcaaggaaacgaagcggcatgcaggcggcgtcgcgctcaagtggcccgccaacggcaagatcgtcgacgggttccggccggggcagaaccgcggcatccagatcgccggccggccgggcgacccggtccgcgccgcggccgacggccgcgtgatgtacgccggcaccggcctgaacgattacggcagcctgatcatcgtccagcacaacgcggattttctgaccgcctatgcgcacaaccgcaagctgctcgtgaagacgggcgacatcgtgcgccagggcgacgagatcgccgagatgggcgacctcgacaactcgcgcgtcgcgttgctgttcgaagtgcggcgcgacggcaagccggtcaatccgatgccgtacctgccttcgtcgcaagggtgaggccgggtcgtttcgctggaacgtggcggcggtcgctgctacgctagggcctgttcatgcgagtcccgtgcttcgcgcggggccgacggccgtctttcggggatgcgcggtgaatgccgtcgcgggccggccgccggtgcgaacgggggcgcttcgttaaggcgtgcccgcgtcgcttcgtgccatcgtttcagacagaagacagaacacacctcatccatggaacactctccgacacgccgctcgctgttgcttgccgccgtggccgcgccgttcgtggccgcgtgcacgtccgcgccggtcgccgaccagggcgcgcccacgccgcccaggccgaattgaccgcgctcgagaaggcgtcgaatggccggctcggtgtcgccgcgctcgatacgtcgaacggcgtgcgcatcgctcaccacgcgcgcgaacgcttcccgctgtgcggcacgtatgcggtcgtcgcggccgccgcgatgctcgcgcgcggctcgctcgacgcgtcgctgctgccgcgccggattctttaccgccgctatgaaatcgtgtcgggctcgccggtcacggaaagccacgtcgacacgggcatgacgatcgagcagctgtgcgtggcgatgctgcagtcgggcgacaagggggccggcaacctgctgatgggcgtgctgggcggcccgcaggccgtcacgtcgttcgcgcgcgcgagcggcgacacgtcgttccgcctcgatcactgggaacccgaactgaatcacgcggcgcccggcgacgagcgggacacgtcgacaccggtcgcgatgatcgacacgctgcagcggctggtgctcggcaacacgctgcccgaaccgcagcgcgcgcaactgacggaatggatggtcggcggcgcgcgcggcgcgaccggcatcgcggcgggcgtgccgcccggctggcgcatcgcggacaaggccggcacgggcggttacggcacgacggccgacgtcgcggtgctgtggccgccgtcgcgtgcgccgatcgtgatggccgtatcgttcacgcagccgcaagccgcggcagcggcccgcgcggacgtcgtcgcgtcggcggcgcgcatcgtggcgggcgcgctcaccgcgacggcctagggccagcgcaagcccgttattagcgtgaacaggccctaacgcctcgcgcctcgcgcaaaaccggcgtttggcttatcgtgtcggacagcgcgcgccggagccggcgcgcggccctttcgcgccgtttttgcgtttgccttcttcatgcaccgacttccgcccctgcacgcactgcagatcttctcgacggtggcccgccaccgcagcttcacccgcgcggccgagcagctgtgcgtcacgcaaggggcggtgagccggcagatccagacgctcgaggcgcattacggctttccgctgttcaagcggcatgcgaagggcctcacgctgacggcggaaggcgagcagttgctgccggtcgtcaacgagagctttgcgcggatcgaggacatctcgatgaagctcacgcggcagcgcaccgatctcgcgctgaaagtgccgacctgcgtgatgcgctggatgctgccgcgcatcatgcgcttccaggacgagcatcccgatctccacgtgcagatcacgaccgcgtggcagcacgtcgtcgatttctcgaccgagccgttcgacgcggcgatcgtctacggcacgtcgccgggcgcgggcgtgttcgcgctgccgctgttcgacgagcggctgacgcccgtctgcgcgcccgaattgcggcagacgtcgccgctcgactcggtcggcgacctggtgcgtcacacgttgctgcatccgacccgcgaccatcgcgactggcgcgcctggctcgattacgcgggcgagcgcggcgtcgatcccgcgcgcgggccgacgttcgacacgctcgatctcgcgacgaacgcggcgatgcagggcttgggcgtcgcggtcggcgacgtgacgctcgtcgacgacgacgtcagcgcgcgccggctcgaacggccgttcgatctcgtgctcgagacgggcgcgcgctacttcttcgtctatcccgagaacatcggcaaccagcagaagatccgcgcgttcagcgactggatcgcgcgccatcgcgactgagcggcgacgcgcgagcgttcaccgaaccggcgtgcggaacccgccgggcgtcgcgccggcgagcggcttcactggtatgtcacgaccgcgatcatcggtgcgtgattgttgccgggacggttcggtaaaacgattgcgcgcgaggcctgagtaaaggtcgtggtcttgatcgcctgctggctcgccgcgtcgacgaacgcgatctggccggctgccgggcgcggacagtcggcgcgtacgcgcccattggcgagatcgggcgtatcgagcgcgaacgagcagggcggctcgacgatcatgccggagaagtggatgatgccggacgcgccggcggcgaaggacgaggaagtggccagaagcgaggcagccagggcgaacgaggcggcgatatggcggtgcttcatgacaggctccatataggaagcgcgtcgcagcggggccgctcgggtggcagtccgtcaacgccgcgatgctgtatgcgtaaacggcaaaaccattgggcctcttgaatgaaaaaatcgaaatagtgactataggcaaacgattgcgaattgcttgaatcaatgtaggccgaatctgcgcaatcgcaagtcagggaaaagccgggggataagatcgaacggcgaacggtcgtcgcgaccgttgtgcgggcaacgggctcgcgccgtccggaataaaaacgccgctcgtctcgagcggcgttttgcgttggggcgaaggtgcgccgttcagttcatgcgcttgcgtaccgcgccgacgatcacgagcagcacgatcgcgccgacgatcgacgcgatccagcccgcgccctggcccggcgagtaccagccggcggcgcggccgacgtagccggcgatcagcgagccgacgatgccgagcacggcggtcatcaggatgcccatcttgtcgtcgccgggcttgagcgcgcgggcgaggaggccgacgatgagcccgacgaccagggtttcgatgaattgcagcatgaacgcctccctattgcggttgagctgttgacgaaacgaagttgacccgtgcggcgcacaagggttccatgcggcggcaagccggcgcgtggcgtgccgagtatcgcatggcggcgcgacgtgcggatgtcacgcggccggcgcgcccggcgcaggctcgagacgacgatagccttcggttgcattcagcagcgtgcgcgtgtagtcgcgcgccacctgcccggcgcgcacgtcctcgatccggagctgctcgacgatctcgccctgctgcatcacggcgacgcgctggcacaggaagccgatcaccgcgaggttgtggctgacgaggatcatcgtcaggttgcgttcgcgatgcaggcggcgcagcaggttcaggatctcggcctgcaccgacacgtcgagcgcggacgtcggctcgtcgagcagcagcacacgcggctcgacgatcagcgcgcgcgcgatcgcgacgcgctgccgctggccgcccgacaactggtgcggataacgaaaccggaacgtggggccgaggccgacctcggacagcgcgcgggcgatgcgcgcatcggtgtcgctcatgccgtggatcgacagcggttcgcgcagcgtctggtcgaccgtgaagcgcggatgcagcgacgcgtacgggtcctggaacaccatctgcacgtggcggcgaaacgcacgatcgggcgtgccgccgaccggccggccgtcgatcgacaggctgccggacgcgagcggcacgaggcccgtcagcgcgcgcagcagcgtcgacttgccggaacccgattcgccgacgagcccgaacacctcgccgtcgcgcaccgcgaagctcgcgtcgcgcacggcgtcgacgtgacccgtgcgggtcgggaaacggatcgatgcgtgatcgacgtcgatcatcgtgcggcctcctgtcgatcggcgggcggcgcgggttcgagccacgccggatcgcgtcgcagcacgggcagttcgtccggcgggttcgcgagcggcgggttcgccgcgagcagcccgcgcgtgtagggatgggaagcgttgcgcaggtcgcgcgcggcgcaggtttcgaccacgcggcccgcgtacatcaccgcgacgcgatcgcagaacgacatcacgagcggcaggtcgtggctgatgaacatcaggcccgtttcgtggcgcgcgatcatcgcgtcgagcaccgcgagcacctgcatcgacacggcgacgtcgagcgcggaggtcggttcgtcggcgatcagcaggcgagggccggtcgacaccatcatcgcgatcatcacgcgctggcccatgccgcccgacagctcgtgcggatacgcatcggcgacgcgcgccgggtcgcggatctgcacggcctcgagtgcatcgacgatccgctcgcgcagcgcggccgcgcagcccgggctcgtgcagccggaacgcttcgcccatctgcttggcgaccgtcatcaccgggttcagcgaatatttcgggtcctgcaggatcatgcccatctggctgccgcacagccgccggcgttcgcgcggaaacatcgcgagcaggtcgtggcccgcgaagcgcatcgtgcgcgccgaccagcgcgcggcgtcgggcagcaggccgagcagcgcgcggcccgtcagcgatttgccggagcccgattcgccgacgatgccgaggcgttcgccgggcgcgagcgtcagcgacaggtcgcgcacggcatcggtgacggtgccgtcgtgcccgcgaaagccgatcttcaggccgtcgatctcgcacagcggcgcgggcgtgggggcggggttcatcggcatgtcacgctccatgacggggatcgaagacatcgcgcagcccgtcgccgagcaggttgaacgcgaggctcacgagcaggatcgcgcagccgggcagcgtcgcgacccaccacgcgtcgagcagcacgttgcggcccgacgcgaccatgaagccccactcggggctcggcggctgtgcgccgaggccgaggaagccgaggcccgcgacggtcaggatgatgccggccatgtcgagcgtcgcgcgcacgatcaccgacgacatgcacagcggcacgatgtagcgcagcaggatgcgcgggcccgacgcgccctgcaggcgggcggcgtggatgaagtcggcctgcgcgatgcggatcgtctccgcgcgcgcgagccgcgcatacgcgggccatgcggtgatcgagatcgcgacgaccgcgttgatcacgccgggcccgagcgcggccgcgaatgcgagcgcgagcacgatcttcgggaacgcgagcgcgatgtcggtgatgcgcatcagcacgctgtcgacgaagccgccgcaatagccggccgtcgtgccgatcgcgaggccgatcggcacgacgatcacgacgacgagcagcgcaatgccgagcgtgaggcgcgaaccggcgatcagccgcgaaaggatgtcgcggccgagctggtcggtgccgagccagtgcgacggcgagccgggcggcagcagccggtcggacagcacctggcgcagcggatcgtgcggcatgatcagcgggccgacgatcgcgacgacgatcagcgcgacgaggatcgcgagcccgaacaggttgagcgggttgccggcgaaacggcgccagcggcgatacgcgaggccgagtgcggcctgcgagcgcgaggcgggcgcgtcggacagcagccacgcgcgcagcgtgagacgctcggcgttcatggttggacgaccttcggcatgggcgatgaaagaagcagggtggaagcggtcatgtcgtgtcggcgcctcagcgcgcgcgcggatcgaacacgcggtacagcgcgtcggtcagcaggttgacggtgatgaacatcgcgccgatcacgagcgtcgcgccgagcaccgcgttcatgtcggcgttcagcagcgcgccggtcaggtacgagccgagccccggccacgcgaacacgatctcggtcagcaccgagccttcgagcaggttgctgtacgtgagcgcgatcacggtgagcagcggcaccgcgatgttgccgaacgcatgccgccagatcacgcggcgctccggcaagcctttcgcgcgcgcggtgacgatgtattcctggctcaactggtcgagcatgaacgagcgcgtcatgcggctgagatacgcgaccgagtagtagccgaggatcgcggcgggcagcgcgatgtgcgatacggcgttgcggaacacgtcccattcgcccgcgagcgccgcgtcgatcagcaggctgccggtgcgcggatcgaccatcccgtcgtacacgggatcgagccggcccggcccgccgacccagtgcagccgcgcgtagaacagcagcagccccatcagcccgagccagaacaccggcaccgaattgccgatcagcccgacgaagcgggcgatgtgatcgatcggacggttgtgcttcacggcggccgcgacgccgagcggcacgccgatcgcgatgccgatcagcgtcgcgatcgtcgccagttcgagcgtggccgggaatacgcgcttgatgtcgtcgagcacggggttcgcggtcagcagcgacatgccgagatggccgtgcagcacgtcgcgcgcatagatcaggaattgcgtgacgagcggcttgtcgagcccgagcgcgatgcgttcggccgcatatgcctcggccgacgcgcgatcgccgaggatcgcgagcacggggtcgatcggcaccttgcggccgatcacgaacgtcagcgcgagcagccccgcgaacgtgacggcgagcgtgagcgtccagcgcagcacgcgcagtgcccagcgcacggccgggcgccgcgcgggcagcgtgcgcagggcttcgaggaggaggcgggagtcgacatgcggtgaatcttattgcttcttcaggttgcggtacgacacgagatcgttgatcggcccgacttcgagcccgctcacgccgggccgcgtcgcgacctgcgcgactttctcgaacatgatcacgaacggcgagcgcgcgagcatctccttctgcatcgcctgataccgttgcgcgcgtttcgcggcggtcggttcggcgagcgcggcgtcggtttccttcgtcagttgcggaatgtcccagctgttgcgccaggccagcattttatagctcgacttgtcggaattgtcggggttccacgcaaatccctgcgcgttgctgtgcggatcgatgtagtcggccgaccattcgccgatgtagatgtcgtgctggcgcgcgcggtatttcgcgagcgtctgcttgttgtcgccggggatcagctgcaccttgatgcccgcctgcgcgaagttcgcctgcacggcctgcgcgatttcggtgtacggataatcgttgcgcacgtccatcgtcaccgagaacccgttcggcacgccggccttcgcgagcagcgccttcgccttcgcgacgtcgagccggtacgggttcgcgttcagcgtgccgaggaagccttcgggcaggaaggtctggtggaccttgtaggtcgtcttcaccacgttgccctggatgcccgcatagtcgacgagccacttcagcgcttcctgcacgtcgggcttcgcgagcgtcgcattcttcgtgttcaggccgagatacagcagcgtcgcctgcggcgatgccgacaccttcgccttgccggatttcacgaccgacgccagatcgtcggggctcaggtcgcgtgccgcatcgacatcgccgttctccagcagcaggcgctggctcgcggcttcgggcacgtggcgcagcacgatgcgcttcatcgcgagcggcagccggtagccgtcgaagcgctgcagcacgacgctgtcgccggcggtccacttgaccagcttgtacgcgccggagccggcctcgttggtcttcagccacgcgttgccgaagtcgctgccctgctggtgcgacagcagcagcttcctgtcgagcaccgaggcgggccaggaacccagcacgttcaggacgaaggtcggcgcgtacttctggtcggtcgtgaccgacaccgtcaggtcgtcgagcttcttcacgttggcgacgacgttcgccttcgtgagcccgatgccggtcagcacggccgccggccccttgtcgagcagcaccgcgcgctggatcgaccacgcgacgtcgtcggccgtcagcgggttgcccgagtggaacttgaggccggggcgcagcttgaacgtgtaggtcagcccgtcggtgctcaccgtccacgactgcgcgacgtcgccgttgaatttcgacggatcgcgcaggtcgacgcgcacgagccggtcgtacgtgttcgcgacgtattcctccggcaccagttcgtagacctcgcccgggtccagcgtcgtgaattcgtcgagcagcgtggccatcacgaacatgtccttcggcgtctccgcatgcgcggcggacagcggaacggcggcgaggacggatgcggtggccagcgccgcgacgagccgggatgtcaggggtttcatctgcgctccatgtgtcgttgaagtcgttgaacgtgaacggtggggagaatgcgtcgggccatcacatcaggcgccacgggccgcttgccgcattgtcgatctggggcagcgcatgcgagccgggcagttcgtagtgccaccattcgctgtcgatgtgcgcgaagccggccgcgtgcatcacgccgagcagcagcaggcggttgcgctgcacggcttcgggcagccccgcgtggaagtggccggatgcggcgaccatctcgtcgaagccggtgcccatgtcgagcggctcgccatccgcgccgacgagcgtcaggtcgagcgcggtgccgcggctgtgattcgagccgcggccgagatcggcgacgaagttcgggtcgggcaggaaatcccacagcacctgccgcctgcggcggccggtacgcatcgtagatgcgcagcgtgaagccggcctgcgcggcgacgttcactgcgcggcgcaacgcggcttcggccggcgccagcagcaggcagtgcgcgcggcggtagatcggcttgccggtcaggttgcggtcggtcgcgtagacgaggtcgatgtcgacgcgatgggtggcgggcgtgatttcgacgaggcggtggtcgttcattggcggttcgggttcggtcgggctcgctcaggattcgaattggtcgaacgtatgctgcagttcgcggttgcgcgcgacgcgccggtcgatcgcggggccgaggcggtcgaccacggccgtgatcagcaggttgaacaggcaggtgagcggtgcgagcgaatcccagaactggccgacgtcggtcttcacctgcaacaggtcggccggccagtcgcgcgcccacgggcacgagaggtcggtgaccagcgcgaacggctgcccgcgctcggcggccgcctggcaatagcggcgcgcgctgcgcgaatacgcgcgggtgtcggtgacgatgcagtacggctgctcgaattcggagttcagcgaatcgacatacgagcccgactggccgtcggaatagaacacgcgcgggcgcaggtactcgaggtagctgctgaacgcgttgctgatcccgcgcgtcgactggatgccgaggatgaataccgcgtccgcatgcgcgatccggtcggccacctgcgcgaacaccggccttcggcgaggcggtacacgtggcggatcgcgtcgagctcgcgctcgagcgacgatgcgagcgggctgttgccggcatcgccgtttccgttgccgtgggccggttgcgtacccgcgatgcggcggtattcgtcgagccggtcggtgatcatccacgggcgatcgcctccgccgcgcagctcgcgtttcaggtcgtcgagattgcggtagccgacgctgcgcaggaagcgcccgaccgagatgccgctcgtgccggcctgctgcgcgatctggtcggccgtttcgagcccgagccggtcgaggttcgcgagcatgtagctcgcgatgcgcttcgcggtcggcgtgagctcggcgtagcgggattcgacggtacgggcgaacgcgcaggtcatcggctgttagatcgttgtcgtctgatgatcgaatgtcatccatctaacgaagccaaaatcattcgcgccagcggataaaaactatggtgtgaggataggtgatagggtcggaagtgcgttcgacggcggggcggtccgcgccggaaagggtatggttttatctctttcaggaataatttgcgtttatgtctgatagagataatttgcgtttatgtcggtcagtcatgttgaccgaatcgaaccgcgatcgtccgctacgtgcctccatctcgtcttgccgtcattcgcacttcacgaccgggctcatcggacctgaccgatttgccgccttcgatcgtcgcccgccatcccgctgcaccgcaataattacaaaattaaagtcgatcagcttcaacacgctgctgctgaccgactgggtcgcgcacacgccgcccgacgtgctcgcgctcaacttcggcgtgccggcagacgcattccggaacatcccgctcgacaacctgtggatcttccagggcgacgaaccgggcccgctcgcggaagcccagcgcgcgtcggcgtcggcagcaggggcgccgccgcatccgttcatcttcccgctcggcgacatgaaaccggtcaggaagacccgcggcggcgaagtgcggatcgcggacagcacgaacttcaacgtgtcgacgaccgtcgcggcggcgctcgtcaccgtgcatccgggcggcatgcgggagctgcactggcacccgaacgcggatgaatggcagtactacctgcagggcgaggcgcggatgaccgtgttcgatacggggccgaaggcgcagacggccgacttccgcgcgggcgacgtcggctacgtgaagaaaagcctcgggcactacgtgcagaacaccggcaacaccgatctggtgtttctcgagatcttcaagaccgaccgctatgcggaagtgtcgctgtccgactggctcgcgcatacgccgccgaagctcgtcgaagcgcacctgaacgtcgcgccggacgtgatcgcgcagtttccgcgcaaccgtcccgacgtcgtgccgctgtaacgccgccgctgccgccgcggccggcagccgacatgccggccgcggcgcccgaccttcaggaatcctgcctcattcgaacggaacaccaccatgattcccgtcacgaacaaacctgccggcagcttcgcgctgccgagtctgcctgccgggcacaccggccacccggccaccccgacggcgcggcgcgtgccgcgctggaagggcgccgcaccggcgtcgccgcgctgctgccgttcgtcggcccggccgtgatcgcgtcgatcggctatatggaccccggcaacttcgcgaccaacatccaggccggtgccgcgtacggctaccggctgctgtgggtcgtgctggccgcgaacgcgatcgcgatgctgttccaggcgatgtcggcgaagctcggcatcgtgaccggccgcaatctcgcggagctgtgccgcgaccggtttcccgcgccggtcgtatggggatgtgggtcgcgtccgagattgccgcgatggcgaccgatctcgccgaattcctcggcggcgcgctcgcattcgggctgttgtgccacctgtcgctgttcgcggggatgatcgcgacggcgctcgcgacctgcgcgatcctcgcgctcgaaaagcgcggcttccggccgctggaagccgcgatcgcggcgctggtcggcgtgatcggcgcgtgctatctcggcgaactgctgatcgcgccgcaggactggcatgcggccgcgttccacctggtcgttccgcagattccggatcgcgcggcgctgacgatcgcggtcgggatcatcggcgcgacgatcatgccgcacacgctgtatctgcattcggggctcacgcaggatcgcaccgcgccgcgcgacgatacggagcggcggcggctcgtgcgcttctcgaatcgcgaggtggtcgtcgcgctcgggctggctgggttcgtgaatctcgcgatggtgatgatggcgtcgtcggcgtttcacgcgagcgccccgggcatgaccgacatcggcgacgcgtatcacacgctgatcccggtgctcgggccggcggccggcgcgctgtttctcgtcgcgctgctgacctcgggcgtgtcgagttcggtggtcggcacgatggccgggcaggtcgtgatgcagggcttcatccaccgccgcatgccggtctgggtgcggcgcgcggtgacggtcgtgcccgcgttcgcggtggtcgcgctcggctgcgacgtcacgcgcgcgatggtcgcgagccaggtggtgctgagtttcgtgctgccgatgccgatgatcgcgctgctgatgctgtcggcgcgcgcggacgtgatgggcgcttacgcgatgcggatgccgctgcggatcgtcgccggcgcggcgacggtcgtgatcgtcgggttgaacgcgtacctggtgtgggcggcattcaattgaccggcggcgggccgccgcccgctgcctactgctgcatgtccggcgcctcgcgcagccgccagatcgcattgcactgctggccgccgaggctcgtcgagcgcagcgtgacgacggtgccgggcgcgatccggtacgtgaaatgcgccgtcagctcggtgcctttccgctgcggctgcccgtcgaccagcacttcgcacagcagcggcgacggcgacccggacgggtgcgtgacatagacgttcagccgcgcgatgtcgcgtgtcgcggtgaacacgacttcgtggttcccgctgccgatcagcatcgtgccgccgggttcgtcgatcgcctgcaggtaggcgcccgcgcttgtctcgatcgttgcggccgcaacggtcagcccggccgagcgcacgtagtcggttgccgcgatgcgcgcggcgaccgcgtcggactgtgccggcgtgccatccgacaatgcgaacggcacgccgtcgcgcagcgcggcgtcgacgtggttcgcgtagtagcgccagcggtcgaggaagcggatgtcgccggtcatgtgcagcgcgcggatcggctcgccgtgataccggagcgtcgtcgtgccggtgccggcatcgaacgcttcgtgaatgccgtacttgctgacgaagttctggaccggatcgagcagcgccgtttcgccctgggcgctccacaggtgcaggaacgtcgtatcgatcccgaagcattcctggaaatcggtgccaatgcgggcggtgcagtcgcgcaggtggccggcgtagcgtgcccacgcgtcggcggtcccggcaacgagcccggcctgcaacgcgctgccgtggcgtgcggagacttcgtcgacgacgaggcgccagtgatggtcgcgccgctcgccgatcagcggcgtgacgacgaacgtgcagaacagcgggtcggggcacgcgtggagccggtcgtcgccgatctgcgagaacaggtcgaacggcggcgcgcagaaccagatgtcggcgtcgtacagcgcgagcttgcggatctgcgggttgcgtgcgcaatactcggcggcctcgatgaagcggccgaccggcagcgcatacgcgctcgacgcgtcgatcacgtcgaccgactggctcgcgaggatctgccgcttgcggtcggacagcccgtagccgatcaccgcgatccggccgtcgtagccggtgtgccgcagcgacagcaggaacggcacgagcatctcgtaccacgcgcggttgttgtcgttgatcgccacgcagaccgcgtgttcgctcgattgcatgttcgcccccgttgcgcgcgcccggctcagtagccgacgtggcgctcgcagacgaccgcgccgcaaccgcggctgtcgtgatacgtaatatgaaactgcttgttgtcccacagccactggaacacggcctggtacacgccggccacggtcatgtcgtgcagcacgatcttcttgcgcgccagcgggccgaaacggttcagttcggcgagcgtctgctcgtacgtatgggtggtgtcgatgaacagcaggtcggcggcgagcggctccatcgcgagatcgtcggcgatccggaattcgaagtcgatcgacaggtctttcgccgcctgctccagttcgggccggatctggaaatactcgtcggagatgtcgaccgacacgaggcgcttcggctgcgcgagcaggaaggccgtcgtggtcagcccggtgaacacgccgagctccaggatggtgtcgcatccggcggccgtttgcgtatagaagtcgaagcgggaggggctgtcgccgagccagccgatcggctcgatcttgtactgaaggaactccattcgcagttgttgtagcgtgcgcatcctgttttccttggcgaagcggattggcggattcgatggtcccgatcgtcgccggttgcggccggcgtccgtggcgtcgcgcattgtagatcgcccgcgccgcacggcatagcaccgccacggcggcccgcggcgattacccgcgcgccggcagggccgggcgcgcgggcgggcgccattatttcgccagcgtgcggtatgacacgaggtcgttgatcggcccgatttccggcccggtcacgccggggcgtgtcgcgacctgcacgaccttctcgaacatgatgatgaacggcgagttcgcgagcacggccttctgcagcgcttcgtaacgctgcgcgcgcttcgcgggcgacggctcgacgagcgcggcctcggtgtccttcgtcagttgcggaatgtcccagctgttgcgccacgcgagcatcttcgtcggcgactggtcggagttgtccggattccacgcgaagccgcgcgcgttgctgttcgggtccatgtagtcgggcgaccattcgccgacgaagatgtcgtgctggcgcgcgcgatacttgccgatcgcctgcttcgcatcgcccggaatcagcttcacgcggatgccgcccagcgcgaagttcgcctgcagcgcctgcgcgatctcgaggtacggatagtcgttcggcatgtccatcgtcacgtcgaagccgttcggcaggccggccttggcgagcagcgccttcgccttcgcgacgtcctgcctgtacggccgcgcgttcgacgcgccgaggaagccttcgggcaggaaggtttcatgcaccttgtacgtcgtgctgacgatgttgcgctggatgccgtcatagtcgaccagccatttcatcgcctgctgcacctcgggtttcgcgaggttcgggttcttcgtgttcaggctcaggtacagcagcgcggacaccggccacgatgcgaccttgatcttgccggccttcgtcagcgcggcgaggctgtcggggctcaggttgcgcgcggcgtcggcgtcgccgttctccagcagcaaccgttgcgcggacgcttcgggcacgtggcgcagcacgacgcgcttcatcgggtacggcgtgcggtatttctcgaagcgctgcagcacgatggtctcgttgggcgtccacttgacgagctggtacgggcccgagcccgcgtcgttggtccggagccagccgctgccgaaatcgttgccctgctggtgcgacagcagcagcttcttgtcgaagaccgatgccgggcatgcgctcagcacgttgagcacgaagctcggtgcgtacttgcggtcggtttcgagcacgacggtctgcggatcgaccacgcgcactttctgcgccacgttcgccttcgtgaggccgaggtcggcgagcacgccggccgggcccttgtcgagcaggatggtgcgctgcagcgaccacgcgacgtcgtcggcggtgaccgggttgccggaatggaacgtgaggccggggcgcagcttgaacgtgtaggtcacgccgtcggcgccgaccgtccacgattgcgcgatctgcccgtcgaagcgtgtcgggtccttcaggtcgacgcgcacgagccgttcgtaggtattcgcgacgtactccgacggcaccagttcgtaaatcccgctcgggtcgagggtcgtgaattcgcctagctgcgtggcgacgacgaagatgccgggcggcgtggccgcctgcgccggcagcgccggaacaagcgcgacgagcgcggcgctgacgaacagccgggacagcaggtgcttcatgcgggctccgttgaaagggaatcgtgggtgcgattctctcatcgacggccacccggatgaaaatattcagcgtgcgcgccgacgggccggcgcgagccgggcggacgcccggcatcggcggggttcggatcagatcaggcagcgtgcgagcgcgaagcgcatcgtttcctcgggcggctcgctgcccgagccgcgcacgaccttgacgaccgaaccgttgcccgacggcgtcagcgtgacgaagtacgagttcgagccgacggcgatgtcggtcacgccgttgtgctgcgattgctcggtgcccggcaggcggctgtcgaggcagttggcgatcgcgtaggccggacgttgcgaggacacgtacatcatcggcgccgcgccggacgaggcggccgagtcggacgacggtgcggagccgcaggcggcgagcagggcggcgggaaggagcagcaggaatcgtttcatggtgggtcgtcgtgtgtctcgtatcgaggctggggcgcggggtaggcgaaacgcgaagcttcgcgacgaaaccgcccggaatcgggccatttttgacggacgacgatgcggcaggcggctgacgacggagatacccgcagcatttgacgccgttgacgcgttgaaacgattcgatacacaacaagcacccgctgccgcgcggcagcgggcgtttcagggggcgaatgggcacctgccggtgttgtcgatcttattggccgatctggtggctgaccgcattttcctgctggttcagcacgtgcttttcgctcttcgtggtgtggctgcgatcctgcgcagccatgtcccgctcttcccggcggatcttgcggtcgtcacggtgcaggcgcgcggcctgtgcgtgcgacatctcgccttccttcacttcgtgacggatccggcgattctggtttgcgaggcgctggttgaccgcttcgcggcgcggatgcgcctgttgccacggcgtgtcggcgaacgcggtgccggtcagtaccgacgtcagggtggcggcgatcgcgagatggcgggtcagggctcgcatggtgttttctcctgtcgttgcgcgctcgaatcgtgggcgcttgtccagaaaacgcggcgcgggcaccggctgttgacgtttccgcctgtatcgattgcaagtctttattacgtcggcgcgtggccccggagtgcgcggcgcggggcccggccgccgcgcacgcggatcaatgcgcgccggccgccgccgcgtcggcatcgccgccgcccgagcgcgacggtttcgtgatccagatcagcggaatgatcgcgacgaagatgatcgccgatacatagaagatgtcgttcaaccccatcacggccgcttgcgaatcgaccgacgagttgaagagggcgagcgccgaatcggggctcaggtgcagcagcgagcgcgtcgtgtcgacgtgttgcgcgaaggtcgggttgtcgatgctcgcctgttcggtgagccgcgcatgatgcaggatcgtgcggtcgttccaggcgttgctgatcagcgacgtgccgacggcgccgcagaacgtgcggccgaaattcgacaggccggcggcggccggaatctttccggcggcagcccggacaggatgatcgacgtcagcggcacgaagaacatcgccatcgggatgccttgcagcagcgtcggcagcacgaggtcccagcgcgacacgtcggtgtagaaggtcgtgcgcatcatgaacacgaccgcgaagccgacgaacgcgagcgtcgcgatgtagcgcggatcggtgcgcggcagcaggcgccccatgaccggcgtgagcaggatcgcgaacaccccgagcggcgcggtggcgagccccgaatcgaccgcgcggtagccgagatagccctgcatccactgcggcagcagcacgagcgtgccgaagaacatgccgtacgcgaccgagatcgcgatcgtgccgcccgcgaaatttcgctgcgtgaagagccgcaggtcgacgatcgggttggcctcgtgcagctcccacacgaggaagaacgcgaagccgatcagcgcgacgatgccgagcgcgacgacgacgggcgagttgaaccagtcgagatccttgcccttgtcgagcatgatctgcagcgacgcgacccacagcacgagcagcagcaggccgaccgtatcgatcggcaggcggcgcgtggccgattcgcgatcccggaacacgatccacgtgacggcggccgcgaagaagcccaccgggatgttgatgtagaagatccacgaccagttgtagtcgtacgtgatccagccgccgagcgacggccccgcgatcgggccgacgagcgccgtcatcgaccacagcgccagcgcgctcgacgatttctgccgcggccacgcgccgagcagcagcgcctgcgacagcggcgcgagcggcccggcgaccgcgccctgcaggattcgcgcggcgagcagcgtcggcaggttcggcgcgatcccgcacagccatgacgcgaacacgaacagcaggatcgacgtgacgaacaggcgtacctggccgaagcgctgcgtgagccagcccgtcaacggaatcgacaccgcgttcgcggccgcaaagatcgtgatgacccacgtgccttcgtcgaccgacacgccgaggtcgcccgagatggtcggaatggcgacgttcgcgatcgacgagtcgagcacgttcatgaacatcgcgagcgataccgcgatcgtgccgatcgcgagcttgccgcccgacagcggggctggagatgacggagtggacatgggtttcctgcgtaagaagcgtaaggtgcttgacggctgcggcccgtcgcggcgggcacgcgccaccgcgcacgcacgcgcgcgaaggcgacgcaggcgcggcgcagctgctgaacggaaaggcgcacggcgcgcgatgcggcccggtagccggggccgacgcgtgcgatgtgcggctcgatcggatgcacgaagccgtgacgggcttcggaaggcgggatgctgccggtcaggaaggcgggacgcgcgtgatgcgtctgcgggcagcggtcaggcggctggcgtcgccggtggagtcgttgtgcatcgcgacaggctaacgatgcggcgagccgccatcaacacgggccggctcattaatcgatttcgcgccgcgcaataatcggtgtgcgaaccgtgccgaaccgagccggttacggtgcggttcgccatgcggtgaacagttccgcgaggaaatcgacgaacgcgcgcaccttgctgtcgagcgtcgcgcgccgcgggtacagcacgtgcagttcgacgtcgtcggcccggtgccagtcgggcagcacgatttcgagttcgttccgctcgagccggcgggccgtgtagtgcgtcgaggccagcgcgatgccgccgccgctcgcggcctggcgcagcaccgtcaccgattcgttggtgatcagcaccggccgcaccggcacgtcggcgacttcgccggccgtattggtgagccgcagcgtcaggccgggcgcgtcgcggccgacgagcagcaggtcgtgccgtgcgaggtcctgcggcgtggcgggccggccgacgcggtcgagatacgcggggctcgcggcgagcttcgcctgcgaccagccgagcgagcgtgcgatgtagctggagtcggtcagcacgcccgcgcgcagcgcgacgtcgaagccgtgctcgacgagatcgagcgggttgttgtcgtagatcagcacgagctggacgagcgggtagcgccggcgaaactcggcgagcgccggctccagttcgaacaggccgatcgagtagggcaccagcacgcgcagcgtgccttccggcgccatgcgcagcgcgcgggcctggcggtccgcgtcgagcaggatgtcctcggcgcgcaggcagcgctcgtagtagtcgcgtccggcctcggtgacggacacgcggcgcgtggtccggtacagcagctggacgccgagatcgtcctcgagctgcttgaccttgcggctcacgcggctgagcggcatgtcgagttgcgtggcggcggcggtgaagttgccgcgctcgaccacgcgcaggaatatgcggatgctttcgaagttcatacggggtgcttccgtgttcgacctgcgcgcatcttaccttcgccggccggatcgctccgtgcggcggcgattatcctgcccggtgcaataacgcatcctgtccgcgcctcttagtggcggccacgcgccccgtatgctcgccgcatgaaattcgccttgcccgatctgccgccgcgcgcggctttccgcaccgtgctgcgcgacgcacggcccacgctgccgcccggtgcgctcgccttcgcgttgcgcaacacggccgcgtcgctgctcgcgctctacattgccttccggatgaatctcgacgacccgaaatgggccgcatcgacggtgtggatcgtcgcgcagggcagccgcgggatgggcttgtcgaagagccagtaccggattctcggcaccgcgatcggcgcggtcgtcgcgctcgtgctgaccggtgcattcgcgcagaccccgaactgttcctgccggcgctcgccgcctggatcggcctgtgcgcgggcgtcgcgacgttccagcggaatttccgcgcctatgcggcggtgctcgccggctacacggccgcgatcgtcgcgatggatgcggtatccgcgccgctgcacgcgttcgacatcgcggtcgcgcggttcctctacgtggtggtcggcatcctgtgcggcgcgctgttcgatacggtcttcgcgccgggcgcgccgctggacgatgtccgtacgcggctcaggcgctatctcgaccgcgcggcggcggtcggcgcgggtgcgctgcgccgcgagccgaacgtcgcggccgtgcaccggctgttcgcggatgcgctcgaactcgacacggcggccgaatatgcggccaccggcgcgccgccggtgcgcaacgcgatcggtcatctgcgcatggcggtgctgggcgtgctgtccgcgcaggccgcggggcaggcgctgcacgatcacgcggcgcgcagcggcggcacgccggacccgctggtcgccgatgccgcgcaggtgctcgacggcgtggcggcgtcgggcgaagcgggcgccgcgctcaccgcattgcgggcgcgcgtggacgacgcggtgcgcgccgaggccgcggagccggccggctcggacccgtcgcgcctgctcacgctcgaccggctggcggcgctgcttgccgggttcgacgccgcctttgcgggcaaggcgcggctggacctgccgaatccgccggcgtcgcgggtgcgctatgcgttccaccacgatccggtgctcgcgtggcacaacgggatgcgcgcgttcatcgcggtgctgatcgccgcggcgttctggatcgtgacggcgtggccgtcgggcgccgggttcgtcgcgatcacgggggtggtctgcgcgctgttctcgacgcgcccgaactcggtgggcgccaccgtcggcttcctgaaaggagccgcctgcgcggcggtcgcgggcgccctttgcaacttcgtgctgctgccagcggtgtcgggcttcgagatgctcgcgtacatcctcggcgtgttcacgatcggcgcgggcatcgcgatgcgccatccacgcgcggccggcatcggcagcggcttctcgatcttcttctggaatttcacgtcgccggacaatacggcgcgcatcggcgacgccgcctttctcaattcggcgcttgccacgctgctcggcatcgcgttcggcgcgatggtgttcgcgctcgtgttccccggcgatcccggcgcgagccggcggcgcctgcattgcgcggtgcgcgccgacctcgcacgcatcgcacgcaatccacgggcgtggccggcgagcgcgtggctgagccgcacggccgaccgtctcgggcgcgagctcggcttcgcgggccgtctgccggccaccctcatcgagcgcgacctgcgcgacttgctcgcggcctggacgatcggcgacagcctgttggcgctggccgaactggcggcgcgcgagccggcggcgcgccgtgcggtcgcgttggtgcgggggcgggtcgggctcgcggatttcgcccggctcgagcgggcttgcggcgcggcggcccgcgtgctgctgcggcgcgtgaccgaggtcgacagcgacgacgggcgcgcgctgctgcgcggtgtcgtgctgctgcggacgatcgcggagacggcggccgcgcatgacggctttctgcgcggtcgccgggattgacgggctgacgggtggaggggcagcggggcgcgcgagcggcggcccgcgtgtcaactgaggcgataggccttgccgggcgtcacttccgccggtagcggctcgcggttcagttcgagcagcgtgcgctcgatcgtccgcgtcatggcatcgagcgcgagatggttcggcccgtcgccgaacggttcggcgatcgcatgggcgatcgcgtcgagcgcgatcagcgtataggcgacgaacacggtgacgaacggcgttgccgcgccgatcgaatcgacgaggccgaacggcagcagcacgcagtacgcatagatcgtccggtgcagcagcacgtcgtacgagaacgggatcggcgtcgacgcgatgcgttcgcagccgctcaccatcgcgacgagatcgtcgaggcgtgcgtcgagcatccacagtcgcgtatcggcgaggcgcccggcgtcggcgcgcgcggcgaatgcctcgcgcagttcgtgaacgatcgcgaccggcgcataccgggcggcggcgatgcgcgtacaggcggcgccgtcgagcagcgtgcgcaggttggccgccggatcggtgccgcgcagctgatgcttcagcgcatagacgaacgcgacgaccttgcgcacgaacgcctgccgtgacgcgtcgtcatcgtcgatcgcgccgtagcagagcgcctgcgacaccagcgtgcgcgtggcggtcagcacgccgccccacagctgacggccctcgcggtagcgttcgtagctcgcgttgttgcgaaaccccgcgaagatcgcgagcgtgagaccgatcagcgtgaacggcgtcgggttcagcggcaccttctcgccgagcacgcggccgccgccccacaccgcgacgacgctgatcgcgagcgtcagcacgagttgcggcaggatggtcggcagcaccgacccgttccagacgagcagcatccgcagccagtgctcgcgcggacgaacgatcatcgccgagctccgtcaggcggcgatcgatgccggcgcggccgcgcgatgcagcagcacgggtaccgacttcgacgtcggcgtgttgcacacgtcgccgacgctgtcgagcggcaccagcgggttggtttccgggtagtacgcgccgatgcagccgcgcgggatgtcgtactcgacgagcaggaagccgtccgcgcgccgctcgatgccgtcgtgccacacggtttccatgtcgacccattcgccggccttcaggccgagcatcgcgagatcgtcgcggttggcgaacaccacgcggcgctggccgaacacgccgcgatagcggtcgtcgagtccgtagacggtcgtgttgtactggtcgtgcgaacgcgtcgtcatcagcgtcatcaggcgttcgccgtgcagcgcgcgggcgcgctggatcggcgtgtcggcgggtagcgggtgcgcgatgaagttcgccttgccggtcggcgtgagccattcgcggtcgcgcgacgcgacgcgcaggtggaagccgcccggccgcgcgatgcgcgtgttgtagtcgtagaagccgtcgagggtggcctcgatcgcgtcgcggatcttcgcgtaatcgtccttgtaggcgagccagtcgaccttgccgctgccgaacagcgcatggccgatgtgcgcgacgatcgcgggctccgacatcaggttcggcgaggccggcttgttcatcccgtacgacacgtggaccatgctcatcgaatcctcgaccgtcacgccttgcgcgacgttgtcctgcaggtcgatctcggtgcggccgagcgtcggcaggatcagcgcgtcgcggccgtggatcaggtggctgcggttcagcttcgtcgtgatgtgcacggaaagatcgcagcggcgcatgccttcccacgtgcgcggcgtgtcgggcgtcgccatcgcgaagttgccgccgaggccgatcagcaccttcacgtggccttcgagcatgccttcgatcgtctcgacgacgtcgtagccgtggtggcgcggcggttcgaaatcgaacacgtggccgagccggtcgaggaacgcctgcgacggcttttcctcgatcccgaccgtgcggttgccctgcacgttcgagtggccgcgcaccgggcacaggccggcgccggggcggccgatgttgccgcgcatcagcatcaggttcgtcagcatctgcacggtcgcgaccgaatgcttgtgctgcgtgatgcccatccccacgtcgcgatcacgcgttcgctgcgcgcgtagagctgcccgaggctgtcgatctgttcgtacggcacgccgctttcggcggtcagcgcggaccagctttcgttgcgaagatcgtcggcaaacgcgtcgaagccggccgtgtgctcgccgatgaacgcggtgtcgagcacgcgcggcgcaccggcggcgcgcgcggcgtcgtcgagttcgagcacgcgcttcgcgatccccttgatcagcgcgaaatcgccgccgatcgtcggctggatgaacgtcgatgcgatcttcgtgcccgacatcgtcagcatctcgatcgggctttgcggatcggcgaagcgttcgaggccgcgctccttgagcgggttgatcgacacgatcgtcgcaccgcgcttcgcgcattcgcgcagctcgcccatcatccgcgggtggttggtggccgggttctggccgaagatcagcagcgtgtcggcgtgctcgaaatcgtcgagcgtgacggtgcccttgccgacgccgaccgacggcggcagcccgcggctcgtcgcctcgtggcacatgttcgagcagtcgggaaagttgttcgtgccgtacagccgcacgagcagctggtacaggaacgccgcttcgttgctcgcgcgcccggacgtgtagaacgcggcctggttcggatcgggcagcgcgcgcaggtggcgcgcgatcagctcgaacgcgtcgtcccacgcgatcggcacgtagcggtcggtctgcgcgtcgtacaccatcgggtcggtgagccggccgtgctgctcgagttcgaagtccgtctgttcgagcagctcggtgaccgtgtgcgcggcgaagaattcgggcgtcacgcgcttgctggtcgcttcggcggccacggccttcacgccgttttcgcagaattcgaacgtcgatgcgtgctggcggtcgggccatgcgcagccggggcagtcgaagccgtccggctggttctggcgcagcagcgtgcggtagttgccgccggtgaccttttccttgatcaggttgatcgtgacggccttcagcgcccccagccggcggccgggtgggtgtacggttcgatgcgcgcggtagcggatttctttcatgatgcaacgggtgtcggggtcgatggccgcagagtacgcgcggcccctgttcggctgtgtgtacacctgttcgcttcaaaaagagtacagtttcggccattcaggcagtgcggatcgcaactgtgttgttgaatggaagttgaaaggggcgcgtgaagcgttacgaacaactggccgacgatctccaggcgcagatcgagcgtggcgtataccggcccggcgagcggattccgtcggtgcggcaggcgagccggcagcagcagctcagcgtcacgaccgtgctgcgcgcgtacctcgtgctggaaagccgcggcctgatcgagagccggccgcaatcgggctacttcgtccgtgcgcgcgcgtcggcgcccgccgaggccgagctgcacatgtcggcgccggccgcggagccgtcggccgtggacgtgagccggctcgtgctgtcgacgctgcgttcgatcgcgcgcgacgacgcggtgccgctcggctcgccgtatcccgatgcgtcgcagtttccggtgcagcgtctcgcgcgctatgcgcagacgatcggccgccgccgcacccgctggggcgtgattgacgatctgccgcccggcaaccaggagctgatccgccagatcgcgcggcgctacgcggagcgcgggatcgcggtcgaacccggcgagatcgtggtgacgatcggcgcgaccgaggcgatcaacctgtgcctgcaggccgtcgcgcggccgggcgacacgatcgcggtggagtcgccgacgttctacgcgatgctgcacgcgatcgagcggatgggcatgcgtgcgctggaagtcgcgacgcacccgggtgacggcatcgatctcgacgcgctcgaacgaatcctcgaacgcgagcgcatcgccgcgtgcatggtgatgccgaatttccagaatccgctcggcttccagatgcccgacgcgcgcaagcgcgcgctcgtcgagctgctggcgaagcacgacgtgccggcgatcgagagcgatgtctatcacgagctgcacttcggcgacacgacaccgagcgcactgaagtcgttcgaccgcgacgggctcgtgctgcattgcgcgtcgttcacgaagagcctgtcgccgcgctaccggatcggctgggcgatgccgggcgctaccgcgaccaggtcgagaagctgaaattcctgaacacgctcgcgacgcccgcgatcgagcagctcgcgatcgccgagtacctgaaacacgacggctacgactttcacctgcggcgcatgcgcaagctgtatgcgcagcaggcgagcctgatgagcgcgatggtgcggcgcttctttccggagggcacgcggctgtcgcagccgcagggcgggtatgtgctgtgggtcgagctgccgaagcaggtcgacgcgatgaagctgtatgcgctggccctcgcggagcggatcacggtcgggcccgggcacatgttctcggccggcaccgattatcggcatttcatccggctcaactacagctatccgtggtcgcggcagatcgaggatgcgttgaaggtgctcgggcggctcgcgtcggagtgcgcggcgcggtgagtgccgccatgcccggcggcaggcggccgatggccggccgccgtgtcgtgcgtcatcccgcgtgcggcgcctgcagcccggcttgcccggcttgcacgacgccgaccatctgccgcatgtcgaaacccgacgggtgctggtacacgcgcagcccgaattccggcagcaccgcgatcaggtgatcgaacaggtcggactggatggcttcatagtcgacccaggtcgtcgtgtcggtgaagcagtacagttcgagcggaatgccttcggccgtgagcggcagttgccgcgccatgcaggtcatgtcgcggcggatgcgcggatggcccttcaggtagttcgcgacatacgcgcggaacgtgccgagattcgtcagctggcggcggttcgccgggcagtcgccggccgcgccgagcgtgccgttccattgctcgatcgcgtcgaccttgtcctcgagatagtccttcagcagcgtcaggcgttcgagccgttcgatctcgtcgttcgaaagaaaacgcacgctcgtcgcgtcgacgaacagcgcgcgcttgatgcggcgcccgcctgcctcggtcatcccgcgccagttctggtagctctcggtgatcagtttccacgtgggcaccgtgatgatcgtgtgatcgaagttcgcgaccttgacggtgttcagcgtgatgtcgatgaccgtgccgtccgcgccggccgacggcatcgtgatccagtcgccgatccgcagcatgtcgttcgacgacagctgcacgcccgcgacgaggccgagcagcgtgtccttgaagatcagcatcagcaccgccgacatcgcaccgatgccggacagcagcaggccgatctgcttgccggttgcgtcgccgatcacgacgagcgcggccgtgatgaacatcacgagcttgacgagctgcatcgcgcctttcagcgacaggcgcggctggtcgcgctggtacgtgcgatgcgcgtgttcgagcgccgaaagcgtcgcgctcacggtcatcgtcacgaggaacacgatcagcgcgaacagcaccttgtcggcgacctgcgcggccgtatcgggaatgccgggcaccgcgccgagcccgagcttgatcacgacgaacgggacgatgcggttcagccacttgaatgcgccgaactcgaacagcgcgtcgtcgacgcgcgtggcggaaagccgcgcgagccgcgcgaccacgcggaacagcaggaaatggacgacggcggtgatcgcgccggcggcggcgagcaggatgaggatgccgacgagcggcgcaaaccaggattcgttcagggtcataggggcaaacaggggccttctcgtgcgttgaaccggcgccgcggcggcgcgcgcccggtgaagggcgcatgaaagggaccgtgattgtgccatcgggttccaggcacgtcgctgtgaacgcgcggcgcgcggctcccggatcggctcaccattgcgcaggtctcctctgcaatcgggtgagggcgggtgacgaaagcgcgtcaccgcaagccggtgtgcgcgtggcttgccggatgcgccgccggttcgtccggatccggcgtgacgccgctgcggcgggcctgcgcgcttcaatgcgcgtgcacggcgatccatgcaatcatgcgggcgtcgcagggttgtcgacgtgccgttcgccttcgcgcgcgggccatccgtcgacggtgagcgacacgtgccgccttcgcgcacttgccatgcgatgcctgccggggcacgatgcgcgaacgacttcgcgaaccacgtcaccccgtattcacgcacttcacgcatgcaagattccaacgaaagccgcccgtcaggcgtgcggctgctgaaaggcatcctcccgatccgccgtggcggggccgtccgcgacattctcgcgggcatttcgctcgcgtcgatggacatcccgcaggtgctcggctacgcgcgcatcgccggcatgccggccgtcacgggcctctacacggtgtgcctgccgctcgtcgcgttcgcgatcttcggcgcgtcgcggcatctggtggtggccgccgattccgcgaccgcgacgatcttcgcgagccggctgtcgtcgatggcgccggccggcagcgccgaatacgtggcgctggccggcatggtcgcgctgctgaccgccgcgatgctgctgctcgcgcgcatcttcaagctcggttttctcgccgatttcctgtcgcgcacggtgctggtcggctttctcgccggcgtcggcgtgcaggtgtcgatcgcgatgctcggcgacatgctcgggctggccgtgccgtacccggcgtcgcgcagtctggcgcagctcgactacgtcgtcacgcatctcgtccacacgaaccggccgacgtttgcgctcgcggcgctcgtcgtcgtcgcgattctcgccggcaagcggttcctgccgcgcgtgccgatgccgatgatcgcagtcgcgggcagcatcgcggcgagcggcacgttcggattcgccgcgcacggcatcgcggtgctcgggccggtcgcgggcgggctgccgccgttgcgctggccgtccgtcacgtggcagcagttcctcgatctcgtgccggtcgccgcgtcgtgtttcgtgatgatcattgcgcagagcgcggccgccgcgcgcgtgttcgcgcagcagtatcgcgaggacgtcgataccaatgccgacatcctcggcctcgcggccgcgaacgccgcggcggcggtgggcggcgcgttcgtcgtcaacggcagcccgacgcagacggcgatggccgacggcgcgggcgtgcgcagccagatcgggcatctcgcgtttgcggccgtggtggcggtggtcctgctgttcttcagcacgacgctgcagtatctgccgcatgcggtgctggccggcatcgtgttcacgatcgcgctcgggttgatcaacgtgcgcagcctcgccgcgatccgcaggaaagccccggcgagttcacgcttgcgctggtcacggccgtggccgtcgtgacgctcggcgtcgagcacggcatcctgctggccgtcgcgctgtcgctgatgcggcacgtgcgccacagctaccagccgcacacgatggtgctcgaaccggtcgaagggaacggaagatggcagccggtgcccacgcggcggggcgcgatgacggcgccggggctgatcgtctaccggttcggctccgacctgtttttcgcgaacgatcacctgttcgccgccgaagtgaccgagctcgtcgatgcggcgccggtgccggcgcgctggttcgtcatcgatgcgggggcggtcaccgacatcgattattcggccgcgcgtacgctgaccgatctcgtcaggatgctgcacgcgcgcggatcggcgtgctgttcgggcgtgtcaaccgctacctgcgcgcggacatggatcgccaccggatcacggagatcgtcggcgcgtcgtgcatcttcccgacgctgcaccaggcgctcgaggccgccggcacgacgccggcgccgcaggagccgggcaccgtgtagcgtcggccctatgcggccgcgcgcaggcgcgcgaagccgttgcgcaggtggcgcgcgagttccgtcgcggccggcgtgtgctggccgcgcggcagatgaaggttgatcgcgaagttcggcagcgcgggcaggccgctgccggccggcaggatgtcgaggtcggccggcacggtcgacgcgagccaggcggtgacggcgaggtcggagcgcacggtcgcggtggtggcgtcgatgctgccgttctcgaacacggtgcgccacgcgcgatcgcagccgcgcagcgcgtcgagcaccgtcgggcggaacgcgcaggtcggcgcgaccatcgatacgggcagcggcgtgttccggtacgcggtgccgcctttcgcaccgacccagaccaggcggtcgacggcgatgcactcgccgcgtgacggcccgaccggcgcctcgatcagcgcgacgtcgagttcgccctgcgcgagccccggtgcagctccggcgacgcctcacacacgagcgtgagcgcgacctgcggatgcgcctgcgcgtagctcttcaggatcggcgcgagacaggtgccgacgagatcctgcggcgcgccgaggcgtacggtgccgtcgaccgcgccggccgtcatgtcggccagcagcgcatcgtgcacggcgagcagccggcgcgcctgcccgagcagccgctcgccgtccggcgtgagcagcaggttgcggtgctcgcggacgaacagcgggccggccagcgtttcgagccgggcgacctgctggctgatcgcgccttgcgtcaggtgcagcgcgcggctggccgccgtcatgctgcgatgatcggcgaccgtgacgaaggcgcgcagcagcgcgatgtcgagatgacgtgccatgcggcgcattatgaacgctaatgacaggcataaaagctttcgctgtcgtaatggcgggatcgcgcgtaaaacagggcttcgacgacgccaaccgggagcttccgtgccgttccgagactacctgccgctgatgctgttcgtgatcgtgtccaccgtgacgccgggcggcgcgacgacgctcgccactgcgtcgggcgcgcatttcggctatcggcgttcgctgccgatgatggcgggcatcgcggccggcctggcgtcgatggccgcggcggccgcggccgggctcggcggcgtgctgcttgcgctgcccgcgttgcaactcgtgatgaaggcggtcggttcggtgtacctcgtgtggctggccgtgcgcatcgggcgcggcggcaagccgcggctggatgccgaggtgcaccgcccgcagggtttcctcagcggcgtctggatgctctggcacaacccgaaaggctgggcgatgacgctcggcgcggccgcgtcgttcgccgcgctcgcgtccggcccgacccggctcggcatattgctcgggctggcgttcggcgtggccgcgatggcgtcgctgtcgctctggtgtttcgccgggctgctgttcgcgcgggtgttgcgcacggagcggcagtggcactgcctgaatgcggcgctcggcgtgctgctcgtgatctcgatcgtgccgatgtggctgccgtagcgggtcggccgcacgtgtcgtgcggccgaccgaaggtcagcgcgaaccggcgcgcgcggtgccggccggctgcccgcccgcacctgccgaccacaacggcaggcgcagcgtcgtgacgacgcttgccgcgtgcagcacgcaaagcaggccgaacgcccacgcatacgcgtttgccggcgtgccgccgcccgccgccgattcgacctgcagccgccatgcgaggaacagcgtgcacacggtggtgaacgtcgggccgccgagacgctgcacgatattgagcgaggtcgtcgccatcggcaggttgcggcgctcgaccgacgcatacgcggcggcgatcgacggtgcgccgatcgcgctctggcccatgccgcgcaggaacagcgccggcacgagcaggtaaggatcgtagccggtcagcgcgaggaacacgaacggcagcgtcgcgaggagtgcgagcaacgcgccggccgaggccagccggcgcacgccgaaccggctcgtcagcgcgcccatcgacggatacgtgacgagcatgccgaggcccatcggcgcgagcagccagcccatttcgccgggcgtgcgcccgcacgcctggatcaggaaaaccggaatcagcatctggcccgcgaacagcgcgccgtttgacaggaactgcgtcgacgcggccgcgccgaacaccttgccgcgaaacagcgcaaggtcgatcagcgcatcgtcgccgttgcgcgtctcgacccgcaggaacgcggcgagcaacagcgccgacgcgacgatcgccgcgatgccgggcgcttcgttgatccgctcgatgccgtacaggaacagcacgagccccggcgacagcagtgcgaggccgacccagtcgagggtgcgccgtggcgcgtcgtcgcggtcggcgggcaggaaccgcgcggccagcgcgagcgccagcacgccgacgggcaggttcacgagaaacagccagcgccacgacgcgtgttgcaggatcgcgccggccacgaccgggccgaggatcggcgcgagcagcacgggcacggccgcgtagccgatcacgcgcgccatctgctggccggcgacacgcgcgatcatcatctgcgccatcggcgcgagtagcccgccgctgaccccttgcagcacgcggaaggcgatcagcgacggcgcggaccatgcgagcccgcacagggccgacgtgagcgtgaacgccgagaagcaccacagatgcagcgcctttgcgccgatccggtcgacgagccagccgttcagcggcagcaccagcgtcagcgcgagcaggtagccgctcgtcacccactggatcgtcgcgaggctcgcgtgcaggtcggtcgcgaggctcgacagcgacacgttgacgatcgtcgcgtcgagctgcgacagcagcgagccgagcgtagctaccgcgacgaccttccagatcgacggatcgagccggccggccgcgcggcgcggcgtcggctgcgcgcgttcgccgctcacgcgccgcgccgatcgagcagcgcgacgatgtcctgcgtcgtgcccgtctcgccgaggcgcgggaacaggcgctcgacgctgttcgcatgcgcgtccgcgttgaggtcggtcatcgcgtcgatggcgagcgtgacgttgtagccgagttcgtgcgcctgccgtgcggtcgactcgacgccgatgctcgtcgcgacgccggccagcacgatctgcgtgacgccggcggccttcaggtgcgcgtcgaggccggtgccggtaaacgcgccccacgtctttttcgtcacgacgtggtcgccgggctgacggttcagttcggggacgagctcggtccagtcgggggcagcgcaccggtgcgcgcctgctgctgcgtgcggcccggcgcaacgccggcgacgttgacgagcacgaccggcaggccgcggctgcggaatgcgtcgagcagcgcgcggctgtgtgcgaccaccggctcgaccgggtgcgcggtggggagggcgacgatgcctttctgcaggtcgatgacgacgagtgccgtgttcgtgtcgagacgggttgcgctcatgatgggggctccgtggaagggacgaggaaagccgtgcgcgcgaatgctgcgaggcgcgcgggccgggttcactgctcgccgatgcggcggatcagcgggattgcggcggcgagcgtgtcgatgtctgcggggtcgagctgctcgatcgcggcgccgagccacttgtgcttggcggcgttgcgcttgagccgcgcgtcgaggccggccgcggtcagccggaacaggatctggcggccgtcggtcggatgcggttcgcgctcgacgagaccgtcttcctcgaggctcgcgagaatcgccttcatcgattgaggcttcatcgcttcggcgcgcgcgagatcggcggtcgtcatcggcccgtgccgctggagtcgcgcgagcgcgcttgtctgggacatgccgagcccgtcggattcgatctcggagcggagccggcggaccagctggccgaccgcgagggtcaggtcggcagcgacgatatcggcggaaacgccggatttgcgtggagggttcatgcggcggatcatagaacatgacagctaaacttgcaagtttagctgtcgaattgaccgccggatcgaggtacggccgggcgtgcggttacgcgcggcgaagcgggaccggtacgacctcgttgtatctcggggtcgcgctctcgtgcagcaggtcgccgaggtattgcgcgagttcgtcggcggcgagcgcggacggaatgtgcaggttggccgcgcgtcgcttgccttcggtgccgagatcgaacacggcccagcggtcgtccttgcgcacgacggcgagtagacggccaaatgcgttgaagcggtattcgtcctgcatggctgcgctcccgtaggtgaatgcgccggccgcccgcgcgctcactggatcgagcaggacagccagcgatggatcttgatggcatcgctcgagacacccgcacgcgtcggtgcgccgagcagcacgaccgtttcgcggcggcccttcacacgcatgcgcatcacgacgccgtgccccgactcgttgatgaagccggttttctgcagccggatcggcaggcggcggtagcggacgagcgggtcggaattcacgtacaccagctcgccgtcgccggggcgcacggtggtcgacgtatccgtcgagaagtagcggatcagcgggtcctgcgccgccgcgccgacgagcttcgcgagatcctcggccgtcgacacgttgtgcggcgacaggccggtcggctcgcggaagtgcgtatggtgcatgccgagccggcgcgcttcgcgattcatcgcgttgacgaacgcggcgcgcccgcccggatagtcgcggctcagcgcggcggccgcgcggttttccgacgacatcagcgcgatatggaacatctcgcggcgcgacagttccgaacccacctgcaggcgcgagccggtgaacttgatcgtgtcgcggtcgcgcgcggtgacgcgcagcacgccgttcagtggacggtcggcgtcgcgcgcgacgacggccgtcatcagcttcgagatcgacgcgatcggccgcaccgaacgtgcgttgcgcgccagcagcggcgtgccggagtcgacgtcgagcacgtaggccgcacgcgaatgcagggcattgaccgcacgcggggtgtagccgcagcttgccatcaggcgcggtttcgcggcggccgggcgcgggcggacggcggtcgtgcgcttcgcgcggcgatgcggggccggggcggcgtgacgcttgatcgtctgatgcttcgcactcgggcgacgatgcttgaccgccttgtgcttgcggtggggtttcttcttgacggctttcttgtgcggatgcgcgtgggcctgcgcggtgcgatgcggctgcgcgcgctgcgcggacgcgttcgcggcgaacgcgagcagcaggaacgagagagcgaggatcagcgtggtccgggcgcgaggcacgcgcgcgatgaggccggtcaagcgaaagtctcctttccacgcgcgaggtggcggcgcggaatgcatgggcggtcagcgggtgcgggaaattataaggtcgatcgcgggaggatgacgagagcagccggccgtcggcgcgctgttttgccggctgccgttgcggtgtgccgcgttttgcgtcgatatgtcgcgccggcgtgacaaacgatggtacggccggcaagatggcgagctcatcgtcaggagaacccatgtcacgccaaccgcatgcgttgcccgtgctgccgcttgcatcgatcgacagcctgtccgcgacaggtgaactcgttgccttcaacgtcggcgcggacgatgcgttgtacgcggcatttgcactggaaccgctcgatgaccggacacgctccgacggcgcttcgttcgcgatcacgaccccctcggctgcgcagcgccatcgcttgattgcgtggcgcgaaggcgaaacgctgctcgatctcgtcgtcgacaacgaaccgttcgatattcacgagatccagccggtgggagacgatctgctggtggtttgctgtcgatcctcttatcgcgggccggacgacttcgacctgaacggccgcctctatcgccgcgacggcacgcgttgcggagaaatactgctgggcgacggcatccggtccgtgcaggtcacgggcacgggagagatctggacgtcctatttcgacgaaggtgtcttcggcaatttcggctgggggcgccggtcggggcgtccggactggtcgcctggagccggcgcggcgaactgcttcatgcgttctcgccgcccgagggctgggcccgatcgacgactgttatgcgctcaacgttcaaggcgaccacgacgtctggttgtattactacagcgaattcgcgctcgtccacttgcgcgaccggcagcctgttgcgtcatggcgtattccggtcaagggcagtcacgcgttcgcggtgatggaagaccaagcgcaacacggtgaatgcgtggcgctgttgtgcggggcatacggcgatcgcgacgtgttgcagctcgtgcgtctgggcgccgatggccaggtacgggtggtacgcgcgtatcgcatgctgaatggtggctcggcgcccgtgggtgtggcacgcgcggtcggccgtggtcgtgcgctgtacgttgtcggcacggacggcaacgtgtatcggatcgacatggcggggctttgcgcggacggtaccgcttaacgcggccagttccgccgcgacacgaccgcgaaactgaccgcgatcgaccccgttaccacgcgcggcggcgggtcgtcgagcgcatcgccgaagcgaaaacggcggctgcgtccgtcgctgcgttcggcacgacgtttcggcgcgcgcgtatcggccgcggcggtgcgttcgttcgcgacggccgtatcgcacggctggtcggccacgcagtcggcggcatgatcgaggggcatgacagtcggttccgggaagggcatgcccgtattgaacgtcattgcattcgatcggtaaaatgaatgtttcaatcgttacgattccttttaagaatggaattgaaactgctgcgtacattcctgaccgtcaccgagctgtgccatttcagccgtgcggccgatgcgctgcacatgagccagccggcactgagcaagcagatcggcgcgctggaggcgagcctcggcggcaagctgttcgagcgcgggcggcacggtgcggagctgacgccgttcggtgagcgtttcctgcccgacgcgcaggcgctcgtgcgcgatgccgacgagatcctcgcgcgcgcacgggaggcgaccagcgggcagcgcgggcatctgcggctcggcatttgcctgtcggtgctgacgatcgtgccgaagcgggtcgcggagtttcgtcgccgcaatccgggcattgcggtcacgttgagcgacctgtcgtcgtccgagcagacacgccggctgcgcgcgggcaagctcgatgccgggtttctgcgcctgccggccgacgaaggtttgtcgtcgttcaaggtggtcgacgaggggctcgcgctggcggtgccgccgcatctcggcttcaagcgcgtgccggccgatctcgacgtgctcaacgagatcggcttcatcgcgctgcagcgtgcgcggggcccgggctcgccgcgcagatcgatcgatggtgcgtcgagcgccgcttcgtgccgcacgtgacacagcaggccgaggacgtgcagtcggtgctgacgtcggtcgcggccggtgtcggcgtcgcgttcattccgtcgcgcgcacagtacctgctgcgcgatgcgacagtgctgccgctcgatggccgggacgcaaagtggcgcgtcgggctggcgtggcggtcggatcgcgacgatcccgtgaccacgcgcttcgtgtcgttcatgcgtgccgcgatcaaggacgcctgacgggcgaagcgatatagtctccgcaatcggcgctgaatgcgcgaatgaatacctgtctgctacggaccgaaccgatgacctcagaatccgacgaatccccgctcgatcccgcactcgtcgcgacgctcgcaacgctgaacgacgccgcgagcgatccggccggcaagacctggtcgttgccgaagatcgcgaaacgcacgcaactgccgatgagcacgctgcgccgcgtgctgacgcagctcgacgccgcgggcctgagtacgacgacgctgaacgaagacggcaccggcagcgccgcgctgaccgacgaagggcgcgccgtgtgcgcgcaactgttcggcgcgaacgacacgcaatgaaaaacgggccgctggaagcggcccgtcgtctggcggttcggtatgcggttcgatgccgcacacctgcgtgtcaccaccgcaccgtgacgccgcccatcaccgaatgatcgtaggtctggtcgttcagcccgcgccgatagccgatgtcgagatcgagccacggcttcggcgaatagatcgcgcccgcgatcgcgaatgcgggattcgcgccggcgccgcgctccgtgttgcgcgacgtgccgatgtcggccacgatctgcagcttgtcggtcgccttgtagatcgccgcgcccgacacggcccagatcgacgtcaggtcgccctggcgattcggctggtacgtcatgcccgcattcgcgaggaacgaaaaccgcgcgacgtcgagctgtccgagcagcgttgcgccggcacccgcgcggccggtgccgagcccgcgccggtcgttgccggtcggcgtcgtcagtttcggcttcagcgcgatcgacagcgggccgcgttcgacgaaccgccatttcatgccgatctcgacatcgccgattcccgcaccgttctcgtcggtccgcgtttgcagatgcgtgtaaggcacgttcacgtagagatcgacgcgttcgccgaacccgcgcgtgagcgtcgcgttccacagctggtggcggccgttttcttcctgtttcgaggtttcctcggcgttgaactcgaactgccagtttgcgttgccctgcgtgcccgtgtcgtcgctgacgagcggatgggtggcaagggcatcgaacggcgcgaggaaggcgctcgcggctgcgagcggaagcattctcttcattgcatcacctgtgtcgtgcatggcgagccggccggcccacgacgaagcgcgcgggccggccggcttcaggccgggaccatcagaaccactgcttgtagcggcgcacgtagatcgtcttgacgatctgcgcgagcaggatatagccgaccatcgtcgcggcgagccacagccagaaggtgcccggcaggtgcatgaagccgagcgactccgcgaacggcgagaacggcagccagcagccgatcgcgatcgcggtgaacgtcgacagcagcaccggcagcgcggccgtgctctgcaggaacgggatcttctgcgtgcgcagcaggtgcacgacgagcgtctgcgacacgaggctctcgatgaaccagcccgagttcatcacgatctggccgcccgcaccgccgttcaggtgatacatcgcacccgcgccgaataccgtccacatcaggatgtacgtcgtgatgtcgaacaccgacgacgtcggcccgacccacagcatgaagcggctgatgttgccggcttcccacttgcgcggcttcttcaggaactcggggtccatcttgtcccacggcagcagcatctgcgacgtgtcgtagatcaggttcagcacgagcagctgcgtcgcgagcatcggctcccacggcaggaatgcgctcgcgacgagcaccgagaacacgttgccgaagttcgagctcgcggtcatgttcaggtacttcaggatgttgccgaacgtctcgcggcccttgatcacgccttcctcgagcaccatcaggctcttttcgagcaggatgatgtcggcggtttccttcgcgatgtcggcgccgctgtcgaccgagatgccgacgtcggcgtcgcgcagcgcgggggcgtcgttgatgccgtcgccgaggaagccgaccgtgtggccgttcgcctgcagcgccttgacgatgcgtgccttctgcagcggcgtcagtttcgcgaacacggtcgtgcgttcgacgacctgcgcgagcgtcgcgtcgtcgagcgcttcgatctccgtgccgaggatcggcttgccgggttcgaggccgacctggcggcacaccttcatcgtgacgatcgggttgtcgcccgtcagcaccttcaccgcgacaccgttttcgcgcagcgcggcgagcgccggcgcggccgattccttcggcgggtcgaggaaggtcaggaagccgcgcacgacgaggtcgtgttcgtcggcggtgcggtactgctggcgctcgtcgccgcgcgggatcgtgcgcgtcgcgagcacgagcacgcggaagccgtcctcgttgtacgcgctcgcctgttcgagcagccgcttgcgcgcgacgaagtcgagcggacgcacgccgtcttcatcttgcacgtgcgtggagacggccagcatctcctcgaccgcgcccttgcagatcagcaggtgcgtgccgcgcgtatcctcgacgacgaccgacaggcggcgccgtacgaagtcgaacggcagttcgtcgatcttcttgtagccctgcggcttcacgcgctcgccgatctcgtcggcacgtgcgacgaccgcgatgtcgatcaggtttttctggccgctctggtggaagctgttcagccagccgagccgcaggatgtcctcgttcttgtggcccgacaggtcgaggtgatgctcgaggatgatcttgtcctgcgtgagcgtgccggtcttgtcggtgcacagcacgtccatcgcgccgaagttctgcaccgaattcaggcgtttcacgacgaccttgcggcgcgccatcgcgaccgcgccgcgcgcgaggtttgcgctgacgatcatcggcagcatctcgggcgtgaggcccacggccaccgcgagcgcgaacgtgagcgcgctcagccagtcgcccttggtcagcccgttgatcatgaacacgatcggcaccatcacgaacatgaacttgatcagcagccagctcacgctcgcgacgccgcggtcgaagctcgtctcgatgcgcttgtggctcacgacgttgcgcgcgagcgagccgaagtaggtgtcctcgccggtcgcgacgacgacggccgtcgccgtgccgctgacgacgttggtgcccatgaagcagacgttctcgagatcgagcaacgatgccgacgtatcggtcgccgcaccggccgcgcgcgtgccggcggatttgcccgcgaccgcgccgagcgtgtcgtacttctcgaccggcagcgcctcgccggtcagcacggcctggctgatgaacaggtcgcgcgacgcgagcaggcgcacgtccgccgggatcatgtcgccggccgacaggtgcacgatgtcgccggtcacgacttcgcgcatcggcacctcgcggcgggacggctcggacgtgtcggtcaccgcgcgctgcacggtcgcggtcgtgcggaccatcgccttcagcttctcggccgcgcgcagcgagcggaattcctgcacgaaacgcagcagcgcgctgatcgtgaccatcgtcagcaggatcgtcatgccgacgtagtcgcgatcgtcgggtgcggcgaaccagacatcggtgaagaagctgatggcggccagcaccagcagcacgtagacgaacgggttgtggaacgagagcagcaactggcgggtccagtgcggcggcttgtcgtgcgcgatttcgttcgggccgtcgtgctgcaggcggccggcggcctggtcgtaggtgaggccgcgcgtgctggtgttcagcgacttcagcgtgtcttcgagcggacgggccgcttcctgcgcggcgcgcatgatgcgcggttcgttctgcgggccggcgccggccttgatgaagccgcgttgtttcttgtgcgaggtgttgtgtcgtgttgtcatgagtcgctccttgcgcacgaggcggcgggcggggagcgaccgtgacgttatcgacgcacgagcgctccccgccgcgtcgcgtcaggcgcgatcggctgtggatcggtgatggcgggaacgctcgccggcgcgtgcggtgcggccggagggcgatgcgcggcgtcgcaccggcgagcggtaatcgactactgtcgtccgagttcatctgcactcctgtcggttgcgggtaatcggcacgggcgatcgaaggcgacgcgcgcacgaaggcgcgcggccggacggcacgcgaacggaaggcgcgcgcggctgacgctgcgcgcaacacgaacgcacgcgcgcgacggcgcggcgcgtgcgttcgacaacatcgaaaattcggcgggagatctggccggtcaggccggaagggcgccgcatcctgcttcccgggatgcggcagaagacgaggctctgcgcgttttcctcaggcagcagtcaagttggtcaggcaccaactacaactcgcatcggtgttcacagaacactccatgtaattagacgggagcgatggtaatgggtcgctgtgcgaagcgtcaaccctttgtcggtcgttatttcgggaaacatgatcggggtgatgtgtgcgtggcgcggccccggattgccgcgaatgaaacggccgcgcgcatgcgtgatcggcatgcgcgcggccgcgtggaagcaggggcgggttactggccggctgccgcgatggcggcccctgcgtcgacaatgcccgagcctgccggcatcgcggtgcacgacgtgccggccgcgagcttggtcgtgcgcgcgccgccttgcagcttctgctggatctgcgcgggcgtgagggtgccgttcaccgacagcatcagcgcggcgatgcccgacacctgcggcgtcgcaaggctggtgccgttcgcgaggccgtaggtgtccgagcccggcgtcgtggtgccggtgttcgacgtcgacaggatgttgacgcccggcgcgctcagcgagacatcggcgccgaagttgctgaacgacgcacggcggccggtcgcatcggtggcgccgacgctgatcacgccgcggcagttcgcaggctggtcgagcccggtcgacaggccgtcgttgccggctgcgacgacgacggtcacacccttcgcggtcacgtcgtcgatggcctgctggaacgtcgtgctgcacgcgccgacaccgccgaggctcaggttgatgaccttcgcggggcgcgggttcgtcggcacgccgttcaccgggatgccggctgcccagcgcatcccgtcggcgatgtcgctcgtcacgccgccgcacttgccgagcacgcgcaccggcaggatctggctgagccacgacacgccggcgatgccggtgccgttgttggcggtcgcgccgatcacgcccatcacgcgcgtgccgtgccagctgctgtcgctcggctggctcgcgcagtgatagtacgggccgtttgcgttgtcgagttcctgttgcgtgacccagtcgcccggatcggttgcgtcagggttgcgcgtcaggccgttgttgctggtattgacgttgctgatgaagctgtagccggacagcacgttgcccatgaggtcggcatgcggccggtagccggtgtcgagcacggccgtgacgacggtcggcgaacccttggtcacgttccaggcgggcggcaggtcgatgccggcggtcgggtcggacaggtaccactgctggttgtagagcggatcgctcggcgtgtcgcggatctgcatcgggtgatccggttccgcgtagtcgacgtccgaatcggccgcgaatgcctgcgcgagcgcggctgcgtcggtggcggccatgcgctggccgagcgacagcacggccgcgccgttcgagatcgtccgttcgacctgcacgttcaccggggcttgcccgaccgtgctcgcataggcgcgtgcactgccggcgaccggtgccgtccagcgcgtcatcgagcgctggatgaccgcgtcgagccgcgtcccgttgtcgatggccgccatcgcgcgcgtggccgtcagcgtcttcagcttgacgatcaggtgatcgatcggcgcttctgccggcgcggcctgcgccgccatctgcacggcggcctgctgcgtcgcgcatgcattgttgccggccgaggcgggcggggtcgtcggagtgccgggagcgggcgtcggggcgggggcaggtgccggtgccggcgccgcgttggaagaagacgggttgctgccgtcgccgccgcctccgccgccgcaaccggcgaggggcaggagggcggcggcggacagcatgccggcgagcatgcgcgcatgtgcggagcgcgccagcgcaagattgaaacgcttggttctcatgttgaaactcgatcctcgtagataaccgtcgtgccggcggtggcgctggtccggctgacccggaccttgtcgtttttgtctggcggccgcggcaagcttgctgcgacgcgccatgcactgggtaacggctggcgcggcggcttcttgagtgcgtttcacgagaaaaaccggggctggcgcaaacgatttcgttgctgcgccgcagcacgaacacgtgtttggaacgtatggcacagaaggcggggtgagcccgcgtgcggccggtcgggcgaaatgtgcggcaggggccggtttgcgcggcacggcaaacgtctttcagtgcgcggccacggtggaaggttgcttacgctttccctgatgcgacgcgaattttgtcgggcgtaggatcgcgattcgatcaacgtttcgtcaggagaaaagcatggatcgccgcttatgctggctggccgtcgcgctgtcctgtgcgctggcgggtaccgcgcacgcgcaggccctcaccggcacgctgaagaagatcaaggacacgggcgtcgtgtcgctcggcattcgcgaatcgtcggtgccgttctcgtattcggacaaccagcagaagaacatcggctattcgcgcgacatcgcatcgcgcatcgtcgaccagctgaagacggaattgaacctgccgaacctctcggtgaaggagatcccgatcacgtcgcagaaccggattccgctgctgcagaacgggacgatcgatttcgaatgcggatcgacgacgaacacgctcgaacggcagaagcaggccgcgttctcgaacagcatctttctctacggcatccgcttcagcacgcgcaaggattcgggcgtgaaggatttcgcggacctggccggcaagacggtcgcgacgacggccggcacgtcggacgagcgcctgctgcgcaagctcaacgaagagaaggcgatgaacatgacgatcatcagcgccaaggatcacgccgaagcgttcatgaacgtcacgaccgggcgcgcggtggcgttcgtgatggacgagccgttgctgtacggcgagatcgcgaaggaccgcaacccgggcgcgtatacggtgacgggcacgccgctggttcacgagaattacgcgtgcatgatgcgcagggacgatccggcgttcaagcgcgtggtcgacggcgtgattgcgaagatgcagacgtcgggcgcggccgagaagctctacgaccaatggttcacgcagccgatcccgccgaagggcgtgagcctcaactatccgctgtcggcggagatgaagcagctgttcaggaatccgacggatcaggcgcagtattgaccggatgcggtgctgatcgacattcggtaatgcaaaaccgccggtgcgtgccggcggttgcggtgtggaaggcaagtggctggaacagcatcaggtcttgagctccgggccacgcgcgaccggtatcgccagggacgctcgaggtaccggcccaagtcaggattcaagcggccgaagcggcccgaagcgtctgctgcaatgcccgtagcggatttccgggtatgccgcaatcggcattcaacctcgtccgtgccaggggaatccggcggcatgacgcgacaacaggcacaatacggcattcgacatgacgcacgggtgttcgcggttcgaacatcgcacgaccgcgtcaccgctgtccgacatcctccccagtcgtcatgaacgccacgctcactcccgcgcgcgagtcgaactcgccgcgtttcctgttgttcctgatctgcctgttcgcgtccgcgggccagcttgcaatcgacatctacgtgcccgcgctgcccgacatggcacggtcgttcgcgaccacgccgcaggcgatccagtcgagcgtgtccggctacatggccgcctacgcgctcggccagctcatcttcgggccggtcgccgacgcatacgggcgcaagcgcgtgctggcgttcgggctcgtgatctacacaatcggctgtctgctgtcgctcggcgcgcagaacctggagacgttcgtgctggcgcgctgcctgcagggtttcgggatcgcgaccaccaacctgctcgcgaaggcgatcatcaccgattcgttctccgggcaggcgctgatgcacgcgttcacgtacatgtcgatcgcgtgggggctcgcgccgatcatcgcgccggtgatcggcgcgcacctgcaggaatggttcggctggcgcgcgtgcctcgtgttcctgctggtgtactcgctggtgatgtgggcgctgctgtggcgataccgcgaaaccttgccgaagccggtgcatctcgagccgcgcacgctgatgacgaacgcgggcaaggtgctggcgagcccggtgttccagagctgcttcctcgcacaggggctgtgctacagcatcctgctggtgttcaacatcgtcgggccgttcatggtgcagaccacgctgcacaagccgccgaccttcttcggctatctcgcgctcggcatcgggctcatgtatttcctcggcgggctgtcgaaccgcattcacgggcgcgggctgccgagtgccgagcaacggctgcgtatcggcgcgcgcgtgatggcaggggcatcggtcgcgatgctggtgctggcgctgaccgtcgggctgcgcgtgtggacgctcgcgacgccggtgctcgtgatgggtttctgcgcgggcgcgatgtacccgacgctgatggccaagggcaattcgctgtttccgcatatcgccggcctgacgagcgcgatcctcggatgcgcgctgctgctcgtgtcgtccgcgatgatggggctggccggtttcgtgtcgatccatgtcctgacgccgctcgcggtcttcttcgtcgcgctgtcctgcatcgtcgtgtggatggtcaccaagctgctgcggtacctgtcgcagcaggaggcggcgccggtggtgtgcgaaggcggcgaggcggcgtaacaggccggctggcaacgcagccaaaccatgcatggctcgctttgcgagtgcctgccaggcccgccgtatcgtgacgccgcgatttttacgggagggcgtatgtacgtcacgaagggcgacagctttcgtcggcgcgttcgtaacccgaatcgcattcccacgagcgtccggtgaaatcgacgtgcgcgttgggtggcacgcgcagtttcgtgcagcctcggccggtctgaatgaagcccacgtcgcattcccatccgaaaccggtgggtaccgcgtgtgcgtgctgcggcattgcggccggtacgcatgacgaaccggcgcggctgaagccgttggggcacgacgattcgcgctcggtgccgcccgcagcacccgggcacccgaggcgatcgacaccccgcggacaggattccggacgagccgcgtccattggcactggtggcggcgtggtgcgcgcgggcgcgtcgtccgtttgtttgagcgatgtgttgcgggacagcgggggcgtgtttcgtgagcgccgtcggcgattccgatggcgaggtccgcccgctgttgcgttgctgacgcggtatcgatgtcgggcgattctcgatcgctgccgcggcgtgctgctggccagcgagccgagcgggggcgcggccaggcgctcggacgggccacggatcagcgcgaagactccgccggctgctaaggcaatgagtgccgcgccgactgcgacccggcgcccgtatcgtgcgagtgacgacggacgcccgtcccgtcgtgcgatgctgcggcgttcgctgatcccttgatcaggcagcccatcggacacgatacgggcggcagccgccggcacggaacgtggctcgtcgggcaagtcgagaccgcatgcgatggcttgcgcgtcggcgtctggtgtggcggccgcgcgcagcgtgacgatgacatcttcgcccgcgccccgtgccgtatatgcgagttggagccactcgaaataggtgtcggcgtcgatcgtatcgatcgaatcggcacgatgcactgcgcgttcaatcacgtcgtccattcgtcatgcctcgtcgcgcaggagcgtcgcggtgccgcgcccggcgacgcccggccatgtcgtccgatgttcgagcgtggcggcgcattcgctgaagaacggatagtcgcgccacgcgtcgcgattgccgatcacgtagagtctgcgtttcgcgcggctgacggcgacgttgagcagattcggcttttccgacgcccatgctttcgcgccggggcggtcgggatggccgcccagtacgagcaggacgacatccgattccttgccctgcaccgtatggatcgtgccgatcttgacattcccgtatcgattgccaagcgcgtcgtaaaccttgcgtcacttcccggaatggggagatgacgtagatcgttccggaggcgtcgtcgtgtgtgtgaatgtcgtcgagaatcgtggcgacagcacgtccctcgtcggggacccagtgtccattcgcattgcgtccctcgacgtgaatccacgtcgtgccgggaagcgcgaactgggcccgcttgacggtgccgaataccatcatcccgttgtacgcgattttgttggcgacattgaacatctcgatgtcgcagcggcgatgaacccgaagcggagcgctgacccagagcgggttgccttcgtggtcgggaagataggtgccgaccgtcgagatccggtcggcgagccgctgaatcgactgacggccgggcgtccacgtcgtttcgacgccgaagcgggtgcgcaacgcctgttgcgaggtgaacggcagcggcaggatcggctcgagttgaagcgggtcgccgaccacgacggcccgcctggcccgccagagcgcgcctacggcggcttgcggcagcccttgtccggcctcgtcgatcaacagccagccgatttcctctcgctggagattcgagaacaggcgaccgaacgaagcgaacgtgctggatatgaccggcaccacggcgaaaagcgtttgccatgcggatttcaccgcctcgcggcatacgccgcccggtacggagccttgcagaatgtcgaccatgccgaacagattggaacggacgatatgggcgttttcggctgcgaacgcctgatgcaggttcagcgcttcaaggaacacctttgcccgggcgtcgttccatgcccggtctgtccatggcgacgacagttcgcgttcgtcgtccgtgcgctcggcacgatcgcgatcgacgaaatgatcgcccaggactatgcgcgcttgggcgagtccggcatcgagtcgcgtaatgtcacccgacagcaccgcgatttcgtcatgggtcgcgcgttcgagtcgttccgcgcctcgacgcgcgacatcggcttgatccacaatgccggcggcggtgtccgtcgcattgctggcttgctgttgggcgtcgatacacgcgagaaatccgattcgccagtcccggtgcgcgcgaccgaagctgaacacgttctcgaagaaacccgggcgcgcatgcaaatgatcgatttttgaacgtgcgcctgctttgctcgttcgatagccgtcgagtgacgtgcccgagcaatttcgtgggcgtttgtcgcgttcgccgtcgcccgattgcgttcccgcgcaagtgcgttcagtgcatcccggcgcgaacgagcagcacgaagcatgtcggcctgccgggcccaatcttcgcgctgcgttcgcagtttcgactcatcggcactggctcgccggaagcgctcgacagactcgcgccacatcgaaggccggcgcctggcgtggtcgccgagccaagtgatgaggcccggtagtcctttttcgctctccggctcgtcgttcgttcgacgatcgtcctttttcatcccaccagacgtcgcgaaggaatgccgtccggttcgtcttgttgccgagacgggctgcgagcaagccccagaccggcttgtcgccgccgagtgcgcgcgcagcgagatccgggaaatagtcgacgctcggtttccacatgtcgtcgattgcatcggctcccggcagttcgagcgtgatgttttcgacggcgccattattggcggaggccactacgatctcgaagcccgagaattccggcttccacaaatagatggtccgctgacgattgccggatccccagccgccgacgccgtcgaacgcgtcttccggtctgcgcagcgacgcgagcatttcagcccgttcgacgacgatgtgcgcgacgagatcgcggagcagggttgtcttgccggtgccgggcggtccgttgacgctgaatatcccggcgtcgttgtccagttcgtgaatcatgcggttgatcgcgaactgctgactgaagaccagcgggtggtgtccgcttgccggccagcgcccggaggggtagcgatcgggagtcagcgtctcgtacatcgtgtcgaccgattgccgggtgtcggtgcgcgcggcgttgtcgatctcgcgatccggcctcagataggacgataaagcggctcccgcgtcgttccgctcgagcgcgtccgcaacccgcgtcagatcgtcgacaaagaagctgttcaggaagtcgacgcggtcgacctgatacgcctttccggcctcgacctgcttcgactgaatgcggacacgttcgtccggcgcctcttccacaaggccgatttcctcgaacagcaatgcggtgatcgcgtcgatgtcgcccaacgtcaatttgcgtccgacgtcgagttccttcgcgagtagcgccttgccttcgtcgtcgtcgtcgggaaccgcgaatatctggcgcaatttgatcaggaagtcggcggcgaatgattcgaatccgtcgagccagtgcggcgaatcgggtccgggtgccgccgtacgtccccacgcccagacgcaggcggacagcacgaacgtatcgaagagcgggcgcccgtcatgatcgacgcgaatcaggaagcatgccgacagactgtcgagccgcgagtcgaacgattgcggatcctgcccgaagatcgactcgagtaattcccgtacgcgccgaacgaggtagacaccgccgtagacatcgtgacgccatacacagtcctttcccgcagccggaaggcgcgtgaatccaggttgccatggcgcgagaagatcgtcgggagtaaaccggtcggtctgtttcgttcgctttccgggttttagatcaatatccggaacagattgcgggttgaagatttcagctgcgcgccagtaacgaagaatctgtgctttcgtattcatttgatgcagaccgatgttgcgctatgcggcgcgaatgaaatgctcgcgtcgtcggatggtgggcactttacctaattgttcgatgaatgggaaatgcgcggcttgatgtggattgttgaaaaacaggagataaaccactgtttattccaaattgcaaaaatgaagcggatatattcgatgccgataatgccagaggagcggagttcagtggttggggtttcgaatgaagtggatcggatgcgtggcccatgaaaagaacggcggcgggactccagaatggattgcaaccgatccgcaagagcatgcgcttgcgcattgccggagcaatggatcggaatatccgcgggatcgctcgcgaccaatccgcgcagcgacgatcgcggcgcttacagcggatgcgtggcgccggcctgctgcaacagcgacacggcagccggatccggcatcccgttcgcgtcgatcgcgccggctttcgcgagcgcgacgagatcgctgtcgacacccggttgcccgaccgtgaacgacgtggtcaggaacgccggcgccgtgagcgtgaccgaatagcgctgctgcaggttcgtcaccacggccgattgcgcggcctgtacggtgttcgggctgttcatcgcctgctggtagcgcggattgccctgaaaattgccgatcaatgcggcggtgttcgtgccgagctgggcggcgagatagaccagcatcagctcggtctcgggcgtcgtattgaacgtgccgcccgcgtacgcgagcgaatgcaggctcgtgccgcccgacgtcacggtgacgacgcacggcagcgcggcattgaccgtcacgcggtagttgccgccgccgtccgtcagcgtcgtcgccgagcccgtcacgcagctgaccgtcacctgcgcgctcgcgagcgcgtcgcccgtcgcggccgtgcccgacagcgcgacggtttgcgtgttgttgttgaagcagacatccacgccgaagcaggcatcgccgttgcacgcctgaagcgctgcgagggtggcgaggcagagcgtgcccagcgcggggcggatgaaacgcctggggtgcaggttcatggtcgctggccttgaggagagtggggcaaccggcaggcgccgacggtgcggcgccgttcacattctatgtcccgaagcggggcgctgcttgcccgtttcggtcgtctggccggcctgaggccggacgcggccggacgacgagcgcgtcgtgcagcggcacactgaaatgacgagatccggaagtcggccgggaacctttcagttcctttcacaattggttatgctgcgggacgattaaaaacgacgagagaacgtgccgttcccgatggagccggcgcgccgtttccgacatgaattcgaaacgacagacgggccggccgtgcgcgccgggcggcgaaggcgatccggcttcgcgggcaggcacggcccgaaccggcattcggcacccacgcggcaccaggggcgtgaccggcaggtccggcttccggaaggccgctgccttgctcgcgggcgcgatcttgctgttcggcggcacggccatcgcggtgccggccgaagatggcagcgttgccgtcgcggcgtccatggccgccacgcttgccaccccggcccggtcggcctgcacacgtggccgccgccgcagcctatccggttgccccgaagccggaagccgcaccgccgctgaaaggccgcgtgacggacacgacgggcgtgctgagcgcggcctgtgcatccgagctgaccgatcgcctcgccgcgctcgaacaacggctcggcgtacaggtcgcgatcctgctggtcgggtcgaccggacaatcgacgatcgaacagtttgcgaccaccgtgttcgaccaatggaaactcggcaaggccgaggtcaacaacggcctgctgctcgtcgccgcgctcaacgaccataccgtgcggatcgaagtcggctacgggctcgaaggcacgattccggacatcgtcgcgggccggatcattcgcgagcggatcgtgccggcattccgcgagaaccgcattgaagccggcatcagcgatgcgctggacgcgctgacgcacgaaatgatgccggccgacgtcgccgcgccggagcagcctgcacccgccacggcgttcggcgggcgcgacgaagcatacgaaacggccgcggcgaccgcgacggatgccgcgaacccgccgccccgcgacgcgcgagccggcggcgaaaaataccagtcgaacggcctgcccgagcggaaacgcccgaacacgggcggcgtgcggttctggttcctgcttggggttgccaacgtcgtgctcggcgtggtcgcgcagtggcgcaagctgcgccgccgggtggcgctcctggccgcctggctcgtggcggccgtcgtgccggtcgtgatgctgccggtcggcgcgatcttcaacggcaatctcgaagccatgctgggcgccgcggcgtttgttccggcggccgccggtgtcgggccgtgcctgctcggcatcaacctgttcctgtcggcgcgcgtgcgcaaaatcaccgcgatcgtgggcgggacgctgttcatgatcgtcgcgatcgggcgcgaaatggactattcggtcggggaagtgctgtccggcatcttcggcgtgctgtgcgtactcgccgtgatctgggcgaagctgacgggcagcggatcgtcttcgtcgtcatcctcgtccggctcccggtcgcaatcgggttccgattcgttccgcggcggcggcgggtcgagcggcggtggcggcgcatcgggccgctggtagcgtccgcgcgcagcctgcctgcgcgcctgattccattcacctgccgctccacccggagcgttcaaccggaaacaacccatgatgaaatggtttcgaatcctgctcgtgtgctgcgtgctggccccgctcgcggggtgcggctacaacgcgatccagtcgtccgacgaggacatcaatgccgcatggtccgaagtgctgaaccagtatcagcgccgcgcggacctcgtgccgaatctcgccgcgtcggtgaagggctacgcgtcgcacgaggcgcgcgtgctgaccgaggtggcatcggcccgtgcgcgcgtgggcagcgtgcagatgacgccggagatggcgaaggacccggccgcgctcgcggcgttcgaccagcggcagggcgagctgtccggggcgctgagccggctgatggtggtgtccgagcgttatccggagctgaaggcgaacgaagcgttccgcgacctgcagacccagctcgaaggcacggaaaaccgcattgcggtcgcgcgcggccgctacatcaagacggtgcagcactacaacgtgcagatccgccagttcccgggcgtcgtgatcgcgaagatcttcggctaccagccgcgcccgaatttcagcgtcgcgaacgaagcggcggtttcgaccgcgccggcactcgatttctccgcgcagtcgcagccgcagccggcgaaggcaaacacggccggcgagtaaggccggagcgtcaggtcgaaacgtccgaccgaagcgcgcattcagggcttgcgcgcggccgccttcgcgaacgcgccgcgcacctcgaagccgatcgcgtcggcaacattgccgcgcgcatcgacgagttcgagccgatgccggcccggccacggcatccacgcgatgcggtcggcatgcccgatcaccttgtcgtcgagccgccacgcgaacttcgcggcgtgcccggccgagcgctcgaaccagatccgctgattcttcggcggaatgtcgggtcgatcgcgaagatcgtgccgtcggtcggcgtgccgatcgtcagcggcgcgcgcgcgccgtccttgcccggcgtgacgggggcggcgagccggatcgtgtcgaccgccgtgcccgcgacgaaccattcgttgcgtgacggttcgatgtcgcgctcgaaggtgatgcggcgcgtctcgacgccggccggcgcgcgcggcgcgcggctcggcacgtcgcggtgcaggtagccgacgacggccgaccacaccggcgacgcgcccgtgacgcccgacacgtcccacatcggcgagccgtccgcattgccgacccacacgccgaccgtatagcgcgacgtgaaaccgacggtccagttgtcgcgcatgtccttgctcgtgccggtcttgactgccgagaagaagcgcgtcgcgagcggattgtcgaagccgaacgtgcgcacgcgcgcgttgttgtcggaaaggatgtcggtcacgacgaagctggctgcctcgctgaacacgcgcgtgccgtcggccgcgcgggcgggcgaggctgccgatgcgccggatgccggcaccggcaccggcaccggcaccggccggtcgacgacctggcgggcgacgccgccgttcgcgagcgcgcggtacgcgttggtcagcgacagcagcgtgacgtccgcactgccgagcgcgaggctgaagccgtagtagtcgccttcctgcgcgagcggcaggccgagcgcggtcagcgtgcgcgcgaagcggtgcggcgtgacgagcacgagcgtgcgcacggctggcacgttcaacgagccgccgagcgcgctgcgcacgctcacccagcccttgaaatccttgtcgtagttctgcgggatgtacaggccgccgccggcggcgaggttgatcggcgcgtcgtcgagcagcgacgcggccgtcagccgtttctcgtcgatcgcctgcgcgtacaggaacggcttgagcgtcgagccggcctggcgcggtgcgagcacggcgtcgacgtcgcgcgcgctcgacagcgcgccggacgaaccgacccatgcacgaatctcgccggtcgcgttgtcgatcacgacgaccgcaccgtcctgcacgttgcgccggtgcgcgggcgcgttgagttcggtcagcgcgcgcatcagcgtgtcgcgcgcgaagcgctgcagcgtcgcgtcgagcgtcgtgcgcacctgcgcgccggccgccggccggacctcggccgcgatgcgtcgcgcgaagtgcggggcgagggcggcgccgtcgtcgcgcgcggcgctggccggccgcgcggtgaccaactgcacgtaaccgtcgagcgaagcgcaggccggctccgcgtgcatgtcgcgcaggatccggcacgcgcgctcggcaaccttcgcgggcgtggcgttgggcgcacgcacgagcgcggccgcgatcgcggcttcgcgtgcgtcgaggcccgacggtgccttgccgaacagcacctgagacagcgcggcgaggccgatcgtctcgccgcggaacggcacgaggttcaggtatgcctcgagcacctggtccttgcgccagccgcgttcgagcagcagcgcgttgacggcctgcgaggccttctgcggcagcgagcgctggcccgaccggcgcggcgaatcgctgagcagcccggcgagctgcatcgtgacggtcgatgcgccgcgcgtgcgttcgttccacaggttgccccacgcggcgccggcgatgccgcgccagtcgacgccgctgtgttcgtaaaagcgcttgtcttccgatacgacgatcgcctcgcgaaacgcgggcgacacgtccgcgagcgacacccagtcgccgcgccgttcggtgaggtcgacgcgcgtgcgctgcagcggcgtgccgtcgcgcgcgagcagcacccagtcggagctgcgccagttgcggcgcacttcgtcgtagcccggcagcgcatgcgcgacgagcggcgcggccagcacgacggcgacgaatacgcggccggcgaaacgcgccggccgcggcaatacctgatcgatcatcacgtactcgttacttgcccgcgtcggccggcttcacggtcatcggcgggttcggccacaggccgtacacggacggcgcgtacagcgcctcgacacgcgtcggcggcagcccgaacgtgccgacgttgttcagccgcaccgtgtactcgaccgagaatttgcccttcggcagatagtcgtagtacgcacggtagccgtcgaagtcgcgctcgatgaacgccggccaggcgccgtccggcgtcttctcgccctgcgtcgcggcttcggagtcgcggccgaggcccgaaccgaggatcgtcgaaccggccggaaccggatcgttgacgacgacccacgtcatgtcgctctgcgcgtcgatgtcgagatgcacgcgcacgacgtcgccgcgcgtcagcacgcccttgacggcgggcgacacgggcgtgacggtcttcgtgatccggtagccggccgcgaacggcgaacgcagcggcacggccgcgaggctttcgatcgtggcccacgggcggccggtgccgtcttgcgtgacggacagcgtggccggtgcctgcgacgcgcgcggccacggcagcatcacgctgcgggccgcggcggcgcgggtggccggggtggctggcgtggtcgatgcagccgggtcggcgggcgcgggtgccggcgcctgcgaccacgagatcgtgcgctcgtcgccgccgagcgcgaccttcgtcgcgccggcaaccggcgtgctttcgtaggtgcgcgagaagcgctcgaccgcgagcaggccgagcgcgttcgacgtggtcgtctgccatgcgccctggcgctgcagggcgagcaggccggccgtcacgcgcggcatctcgtccttccacgccggatcgccggcgaattccagcgcgaggcgggccgcgttggtctcgttgctggtcatcagccaccacaggtcgtcgtcgcgcgcggtcgagaacacgagctgcgtgccctggtacgtgaggcgtgcccgcaggatctgctcgacctgcgcgcgtttctcgtcgcgttgcgggatgtccttcacgcgcgtgaggatcgcgtgatagtcgatcaccgccgacgtcggccactggttcggcgcgatctcgatcgagccgagcatgcggccctgcgccgcgccgtagcgcgacagcgcctcgatcgcggcgagcttgcggaggtcgcgatcctggcgcggcgcccacgtgttgcgctcgagacggccgtcgacgaagcgcgcgagcccggcttcgagctgcgtgcgaaggtcttccggcagcgcgaagcgcgggtcgagacggcttgcctcgtcggacaccacgagcaggtacgacgacagcgtcgcgctgccggcgtgcgaatcgtcggacgacggcgggaagtagctcgcgagcccgtcgctgtcgagatagacaggcatgcgggcgatcagcgcctgccattgcgcgggatcgcgcaggccgatcgcgcgcgacgtctgctgttcgaggcagcggtacggatagcgctcgaaccagcgcttcacgccgggcagtccgtcggcgagcttcgactgcaacgacacggcgatgccgccgcgcggcaagccttgcgcgttgttcgcggcgccggccgggaggccaccggcaccgtcagcgtgccgtcgacctgcgcgagcgtcgcctgctgaaccgtgaccggcagcgcgggcacgaccttctgcgcgaccgccagcgcgtcggacgcgcgcttgccgccttgttcggccgcttcgatgcgccagttcagcgcaccggccgcgtcgagcgcctgctcgggcacggtgatcgtccatgcgacttcggttgccgtattggccgccagcgacacggtttgcggtgcgacatcgaggcccgtcacgcgcggcgtcacgacgacctgcatcgcgcggtcggtcgtgttgcgcagcgtgacctgcgcgcggaacgcgtcgccttcgcgcacgagcggcggcaggccggagatcagctgcagatcctgcgtactgcggatcgacgtgctgccggtgccgaagcggtcggggccgaccgccgcgatcgcgacgatccggaagcgcgtgagcgcgtcgttcagcggcacctcgacggtcgcgctgccgttggcgtccagcgtcacgcgcggattccacagcagcagcgtgtcgaacagctcgcgcgtcggcgcgctgccgccgccgccgccggccggtacggccttgcggccgaagtggcggcggccgacgatttccatctgcgcggtggccgtctcgacgccgtacgcgcgtcgccgcagcatcgcgtcgagcaggtcccagctgttgttcggcatcagttcgagcagcgcctcgtcgacggccgcgaccgcgatctgcgtgccggccggcgcgggctggccgttcggcagcgtgaccttcacgtgcgcctgcgccttgctgcgcacggtgtagcgcgtcgcgtcggtcgtcacggtcacgccgagacggtgcacgccggtgccgaccttgatctcgccgaggccatagcggaacgcgggtttcgacaggtcgacgaacgcggtcggcgcttcatagtgacggccctcgcgccagaatgcgcgtgcccattcgaccggtgccttccagccccacgtgaaaaacgagtaccacggcacctcgcgaatccggccgcgcagcgcgagcaccgacacatagacgttcggcccccacgtgtcgccgaccttcaggtcgaccgtcgggttcttgccgttcagttctacgatgtgcgtttccatcacgccgccgcgctcgaccgccaccagcgcggtcgcgtagcggaacggcatgcgcacctggaagcgggcggtttcgcccggttcgtacgaggttttctcggggatcacgtcgatccggtcggtgttgtcgccgccgaaccagagttcgtcttcgcgcgtgacccataccgaggtcgacgcgttcgacgtgcggccgtcgccgtccttggccaccgcgatcagctgcacgttgccggcctgttcgagcgtcgcgtcgcaggccatgcggcccttgtcgtcggtcttgcccgagcacagcacgccgaggtcgcgcgtgtcgctcttgttgtcgtacgcatagaagccgccgaccatccgcttgcgcgacgacgtcgtgatgcgcgcgacgcccttgatctcgatcggcaccgacgcgcgcggcttgccttgcaggtcgaccgccagcgcctgcacgggcacgcgctggccgacggagacccagcggcccgccttgatgccggccaccacagcggccggccacaggatcgtgtcgccgcgaatcgtctgcacttcgccgttcgggtccgcgaacgtcgcttcgagcgcgatgcgcttcggtgcgtcgacgtcgggcaggcccttcagcgtgaccgagcccgcaccgttgcggtcgagcgtcagcggcagcttgtcggcgatcagcttcgtcgcgtcgggatcgttgttcgacgacgacgcgttgtcgccgtcctgcgaatcgtcgtcggcattgccgtcgctcgtgtcggggcgatacggcgtgaagctgaaatcctcgaagcgatcggcgaacggcggcgatgcccacttcatcagcgccgacacctgcacgggcaggttcgatgcgccaccgcccgacacgtagtcgatctgcaccgcgagcggcgcttccttcacggcgacgagcgggctcttctgcgcgtcgcgcgcgccgatcgatcccttcagcaccggcaggcggaacgcctcgacgcggaagctgccgctgtagtaggtggacgtgggcgagtcttccgggccgccttcgagctcgacgctgtattcaccgagctttgcggcggccggtagcgtgaactgcgagtccgcgctgtgatcggccgcccatgtgagcggcagcttgtaggtctggcccgtgccgagatggcggatcgtcacgcgcgtcgggtattgcgacgggaacgcgaggctctgcagcgtctccgaccggatgaagtgcttcatcgacacggtttcgcccgcgcgcagcagcgtgcggtcgaacaccgtatgtgcgcgcacggtccgggcgctgtcggtatcggtcggcacgttgaagcgccacgattcgatcccgcggttccagcccgagctgacgaacgccatgtcggggcccgtcttcggatcgttcacgcgggccgacacgaagtagtcgtcgaagcgttgttccgagtcggacgagttgcaagcgcgcttcgattcgaacgcgccgtcgatcttcagcagcccctgcgcatcggtcgtgccggatgcgatttcgtcgccgttgcagtccgacacgcggatctgcgcgttcggcacgggcttgcccttgtcgagcgtcgtgacccacacgaggttgttttcgcggccctgtttcaggtgcacgccgaggttggtgacgagcaccgtggtgcgcacgtacatgctcgacggcttcgcgagcagcgagcggccgagcgcgggcgacgcgagttcgagcacgtagaagccgggcttgtcgatcggcacgccgacgacctcgaacgggcgcagcgccttcgggtccgccttcggcagcgtcagcgcctgcacgccgggctggcccttgagcagggtcagcgagcgcacgtcgatgcggcgatccttcggtgcgggcgccttctcgccggcctcgcgcggcacgtagacggggtgctggcccttgcgttcgagcaggccgggaatctggctgtcgatcgagccggccgtcatcgaccagttgtcgaagcggtcgacggtgcgcatccactgacgaatcgcggtgtcgtcgtcgaccttcaggttcgagaactgcgcgccctgggtgttcaagccgtcgatatgcaggtcggcctcgacgttgcgcagcgtgacgggcacgagcgcgggcgtatcgggttcggcgaagcgctcgacgatcccgaaggtgcccgacgagaacttcgcgagcggcggcatcggcgcggtgcgcgtcgcgagcgggaacaggtcggcgttcgacagcggccggtcggtcacgtcgcgcaggcccgacggcaattcgaccgtcaggccggcctgctcgggcagcggcgggttgaacgtgacggtggtgacttcctcgctcttgtcgtcggccgcgaaggtcggcgacagcgaaccgtcagggccgcgcagcttgatcgcctcggcgttcttgcgcgagatcggcgcgttgaacgacagcgtgagcgggcgcagcggcgtgcagggcgccttcgcgttctcgcgttcgcacgagaagctcgcggcgaacggtgcgcgcacggtgaaatcgaagcgccgttccgtttcgttcggaatcccgctcgggctcgtgacgcccttgccgtacacgagctgcatcttcgcgctcgcgggcagcgcctgcgcgcacgacagcgtcagcacgcgcgcggcatccttcttcagcccgaagtgatcgagcagcgcgttgcgcgcatcgtcgtcggcggccgtgacgggaatgcggttgccgatgccggccgcttcgcaccagatgttcgcgagcgccgaacgcggttcggccgggccgttcagcttcagcacgaatacctggtgttcctcgatctcgcgcgagccggggcggacgttcaccgggaacgggccgcccgtctggaacgtgaagcggcgcgggccgctggccgcattgccggcgaccgaacgcaacgtgtcgttgagcgcgaccgagcagcgcacgccgggcggcaggtcgttttcgaaatcgtaaacccaggtcttgtcgtcgagccagtgaccctggccgcgcggccgcggaatcgttgcaggtgacgcgcgcgggattcggcgcggacgccgagccgaacgcgaccatcggttcgtcgaacttgacgacgctctgccggacttcggtgacggtgccttgcggcgagacgctcaccgtgcgggccgcgccggcatgcagcgacagtgccgtggcgccgccgagcgccgcgacggcgccaaggcgccagagcagccgggtggtgtggtggatgcgttccgttttgttctgtttgtcgtgctgcttcatcgctcgatcgccctcggaggaagctttctgtttgattgcacgcgattctaaccgaccgacatgcgcctgcatcgtcgcgcgcagtcagtgtgtcgccggtgtacgacatgggtgcgtcggccgcaactttgtcgcgccgacgatacaaaaagcagcgaaatgtcgattgtctcggattgcggaacatttaatggactataaaagattgttcgatccgatttgtgcgcgtacatttcaggtccgcgccaatgtttgagaaatatcaagcgtggttttcccgaatccggtgttcgagagaaaaggaaacatgcacaacgacaacactccccactcgcgtcgcactggcgacgcagccgtaacaggcatcactcggcgtcaatggctgcagggcgcactggcgctgacggcggcgggcctcacgggctcgctggcgttgcgggccctcgccgacgatcccggcaccgcgccgctcgatacgttcatgacgctctccgaagcattgacaggcaagaaggggctgagccgcgtgctcggccagcgcttcctgcaggccttgcagaagggttcgttcaagaccgccgacagcctgccgcaactcgccggcgcactcgcgtccggttcgctgaatcccgatcaggaaacactcgcgctgaagattcttgaagcgtggtatctcggcatcgtcgacaacgtcgtgattacctacgaagaagcattaatgttcagcgtcgtgtccgatacgctcgtgatcccgtcgtattgccccaacaaacccggcttctgggccgacaaaccgatcgagaggcaagcctgatggccgataccgatacgcaaaaggccgacgtcgtcgtcgtcggctctggtgtcgcaggcgcgatcgtcgcgcaccagctcgcgatggcgggcaagtccgtgatcctgctggaagccggcccgcgcatgccgcgctgggaaatcgtcgagcgcttccgcaaccaggtcgacaagaccgacttcatggccccgtacccgtcgagcgcgtgggcgccgcatccggaatacggcccgccgaacgactacctgatcctgaagggcgagcacaagttcaactcgcagtacatccgtgcggtgggcggcacgacgtggcactgggccgcgtcggcgtggcgtttcatcccgaacgacttcaagatgaagaccgtgtacggtgtcggccgcgactggccgatccagtacgacgacatcgagcattggtaccagcgcgccgaggaggaactcggcgtgtggggcccgggccccgaggaagacctgtactcgccgcgcaaggagccgtacccgatgccgccgctgccgttgtcgttcaacgagcagacgatcaagagcgcgctcaacggctatgacccgaagttccacgtggtgaccgagccggtcgcgcgcaacagccgcccgtacgacggccggcccacttgttgcgggaacaacaactgcatgccgatctgcccgatcggcgcgatgtacaacggcatcgtgcacgtcgagaaggccgagcaggccggcgcgaagctgatcgacagcgcggtcgtctacaagctcgaaaccgggccggacaagcgcatcaccgccgcggtctacaaggacaagacgggtgccgaccatcgcgtcgaaggcaagtacttcgtgattgccgcgaacggcatcgagacgccgaagatcctgctgatgtccgcgaaccgcgatttcccgaacggtgtcgcgaacagctcggacatggtcggccgcaacctgatggaccacccgggcaccggcgtgtcgttctacgcgaacgagaagctgtggccgggccgcggcccgcaggagatgacgtcgctgatcggcttccgcgacggcccgttccgcgcgaccgaagccgcgaagaagatccacctgtcgaacatgtcgcgcatcaaccaggagacgcagaagatcttcaaggccggcaagctgatgaagcccgaggagctcgacgcgcagatccgcgatcgttccgcgcgctacgtgcagttcgactgcttccacgaaatcctgccgcagcccgagaaccgcatcgtgccgagcaagacggccaccgacgcgatcggcatcccgcgcccggagatcacctatgcgatcgacgactacgtgaagcgcggcgccgtccacacgcgcgaggtctacgcgacggccgcgaaggtgctgggcggcaccgaagtcgtcttcaacgacgagttcgcgccgaacaaccacatcacgggcgcgacgatcatgggcgcggatgcacgcgactcggtcgtcgacaaggactgccgcacgttcgaccatccgaacctgttcatctcgagcagctcgacgatgccgaccgtcggtacggtgaacgtgacgctgacgatcgcggcgcttgcgctgcggatgtcggacacgctgaagaaggaagtctgaccgtgcggaaatctactctcaccttcctcctcgccggctgcctcgcgctgccgggcctcgcacgcgcggccgatccggccgatccggcgctggtcaagcgcggcgaatacctcgcggtcgcgggcgactgcatggcctgccacaccgcgaagggcggcaagccgttcgcgggcggtctcggcatgccgatcccgatgctcggcaagatctatacgagcaacatcacgcccgatcccgagacgggcatcggcaactggtcggccgaggacttcgagcgcgcggtgcgccacggggtgtcgaagaacggcgacaacctgtatccggcgatgccgtacgtgtcgtacgcgaagatcaacgacgacgacgtgcaggcgctgtatgcgtacttcatgcacggcgtcgagccggtcaagcaggcgccgccgaagaacgagattcccgcgctgctgagcatgcgctggccgctgaagatctggaactggctgttcctgaaggacggcgcatacgagccgaagccggcgcagagcgccgagtggaaccgcggcgcgtatctcgtgcagggcctcgcgcactgcagcacgtgccacacgccgcgcggcatcgcgatgcaggagaagtcgctcgacgagacgggcggcagcttcctgtcgggttcggtgctggcgggctgggacggctacaacatcacgtccgacccgaacgcggggatcggcggctggacgcagcagcagctcgtccagtacctgcgcaccggcaccgtgccgggtctcgcgcaggcggccgggccgatggccgaggcgatcgagcacagcttctcgaagatgaccgaagccgacatcggtgcgatctcgacgtacattcgcacggtgccggcggttgccagcggcgacgcgaagcagtcgcgctcgtcgtggggcaagccggccgaggacggcctgacgctgcgcggcgccgcactcgcgtcgtcgggcatcgatccggcgcggctgtatctcggcaactgcgcgacctgccaccagatgcagggcaagggcacgccggacggttattacccgccgctgttccacaactcgacggtgggcgcaccgaatccgaccaacctcgtgcaggtgatcctgaacggcgtgcagcgcaaggccggcagcgaggacgtcgggatgccggcgttccgccacgagctgtcggatgcgcagatcgccgcgctgacgaactacctgaccgggcagttcggcaatccggccgcgaaggtgaccgagcaggacgtcgcgaagctgcgctgatgcggcgcgcgacgaagcagggcgataactgacaagaggaggagcacagcacatcgggttgttgcccgatgccggttgttgcagagcgggacgggcggcgcaggcggccgcccgtcctggttcattcgcaatccggtgcgccgggcgtatttgcgccatgcgcatcgctttcgttgatcgacaccatgacaccgaatcaaccgtttctcgcgtcccagtgcgatgtgctgctgctgcttgcccggatcctgctcgtgatcctgttcgtgatgttcggctggaagaagatcgtcgacttcccggtaccatcgcgttcatgggttcggaaggcgcgcccgcgccgatcatttccgccgcgatctccgtcgtgatggagctgttcgtcggggtcgcgatcctggtcggcttccagacgcgtgcgctcgcgctgctgctggcgctctatacgatcggcaccggcatcatcggccaccactactggacgatgacgggcggcgagcagatcaacaacatgattcatttctacaagaacatcgcgatctccggcggcctgctggcgctttgcgcggcgggccccggacgtttctcgatcgatcgcggataaacggacccgggcgcgcatggggcgcgcgctggaaggtcgagactccgagggggcatcattttgcgactcaaacatttcgcatggctgatcgcggccgccacaccggcggccgcttttgctcagacgagcgtgatgctgtacggccgcatcgacggcggcatcgaatacctgaaccacatcgcgcagccgaacggcggcagcgcgacccgctggagtgccgaaggcggcgactggggcaccagcatgttcggcttgaagggcttcgaggatctcggcggcgggctgtcgacggtcttcaacctggagaccgcgttccaggtgatgaacggcacgacgggcggcgggcgcatgtggtcgcggcgcgcgtatgtcgggctgaagagcgacacgtggggccagctgcaggccggccgaaacctgttcatcgacagtgacggggtgtgggaattcgacccgttcgtccagcaggcgttttcgtcggcatcgctcgtgcgcggtcgcaactggcagcagaccagcaacaacatcgaatatcacagccccgtgatcggcggcttcgacgtgcaggcgcaatatgcgttcggcaaccagtcgcgcggcttcaactatggagctgccgacgacttcggccgctcggacgggatcatgatctcgtaccactcgccgttgctcgacgtacgcggcatctacgacgagctgcgcgacaacaacggcaagttcagcaacatcttcaccgcgtcgcgcgaatatttcgtcggtgcgaacgtcaaggtgtcgaagttcaagatccagggcgcgtatacgcactaccaggcgccggacagcccggccggggtggccgatcgcgccgatcactactggctcggtgcgacctacactgcgacgccgcaatgggccgtgacgggcggcggttactacgtgaaggtgggcgacggcggcggcgacgcgtcgcacgatccgtcggggcacgcgatgatgtacgtgctcggcaccacgtacaacctgtcgaagcgcacgttcctgtacggcacggtcgcgtatgtgcgcaacggcggcaactcgaacttctcgctgctcgcgacgccgcgcgacgcgacgtcgggtacgagcccgatgacgggcgagtcgcagacgggggcgtatgtggggatgatgcatacgttctgagcggcgaaggtagacgccttgcacgcaacagcgcacgggaggttgccgtccgtgcgttgttgcgttgacggtgtgaccggtgccggtcagaacacgcatgcgtcggtcgtggtgagcgtcgcgaacgggccccaagcgttgcgttgtgatgcgcaatgatccgctcggccggcagttcgggcgtatccatgcaggtgtgcgcatcggtcacgagcaccgcgcgaaaaccgagatcgccggccgcacgacacgtcgtatcgacgcagtactgcgtcttcatccccgcaatcacgatctcgccgatgccggccgcatgcagccatgcggcgagcggcgtgccggtgaagcagctcgactgcgtcttggcgaacacggtatcgcgtgcggcatcgattgcgagttcaggcagcagtgaggtcagcggcgagtcgggcgcgatcggcgaaccggcggggccggtgtgccgcaccgcgaataccggtgcaccggcttcatgcgcgcgatcgatcaaccggttgatgttcgcgagcacacgttcgccgtcgtacggacgctcagggccgtgatacaggccgacctgcatgtcgacgacgagcagggcgcgtttcgggaagagacttcgggcatggcgtttctcctgagtgaccgatacggacggagaaacgacaagaccccgtccgaaccggcggggcctgtgaggaatcgtggcgctacgaccttgcgcgcactcgccgcacgagcccgccgaaggcggtcgtgcgtgtcgtggtcgaggaggtggtcgtggtgtggcgcatggagcgatcatgcccgatacgcacgcactgcgtcaatcgcgcatccggcatcgcccatcggtcagtcgagtgctttcccggcttttcgtccatgcagcggatggcgagcagcgtgaacgcaccgcaaccaatcgcataccacgccggcgcattcggattcccggttgccgcgatcagccacgtgacgaaaaactgcgcgaagccgccgaagatcgcgacgcccacgctgtacacgagtgcgccgcccgtcgcacgcaccgcacgcgggaacagctcgccgagcatcgcacccgtcgcgccgatgttgatcgcgtgcacgatcgacagcgcggcgatgatcgacagcagcgatgcggcgcccggccagcggttcagcgcgatgaacgccgggtagatcgcggccatcagcgcgatgcgcgtccaccagacgatccggttgcgcccgtagacgtcggacaggtggccgccgatcggcgtcacgagcatcaggatcgcgcccgcgacgcagccggccgtcatcgacagccaggtcggcagatgcaacacctgcacgccgtagatcgccatgtagaacacgatgatgtagtggatcgacgtgccgccgatcgttacgccgaggcccgcgaatacggccttgccgtgatggcgcagcacgtcggcgagcggcagcgatgcgaccggctcgtcgtgtgtggcggcgggcgcggcggccggcacttcctcgacggtgcggcgcagccagtagccgagcggcacgaacagcgtgccgatgatgaacgggacgcgccagccccagctttcgagctgcgcggcattcagcgtcgacgtcagcgcgacgccggtcagcgcaccggcgagcgcggcgagtccctggctcgagaactggaacgatgcgtagaaaccgcgacgatgctgcggcgcctgttcgagcagcagcgtggtcgacgcgccgacttcgcctcccgacgcgaacccttgcagcaggcgcgcgagcacgagcagcagcggggcggcgaggccgatctgcgcgaaggtcggcgcgacggcgattgtcgcggtgccgagcgccatcagcagcagcgtgaggatcatcgccttcttgcggccggagcggtcggcatacatgccgatcacgagcccgccgagcgggcgcgtgacgaagccgacaccgaagctcgcgaccgcgagcatcaattgcccgaacgacgaatgcacgggaaagaacagcttgccgatcaggatcgcgaagaagctgtagaccgtgaagtcgtagaactcgagcgcgttgccgacggcggcggccgcgatcagccggcgtttcttcgcggcggcgcgagcatcgaccggcgtgccggcgagcgaaagggcggacgtttccatgtggggttccccggttggcgcgaaacgatgggatgaagggccgtcaggccgcgagccaggcttcggcgatgcgaacccagtagctcgcgccgatcgcgagaatgtcgtcgttgaagtcgtagccggggttgtgcaccatgcagccgcccttgctgccgatcccgttgccgatgaatgcgtagcagccggggcgcgcttcgagcatgaacgcgaaatcctcgctgcccatcagcggcgcggcgtcggtttcgacacgctcggcgccgagcatctggcgtgcgatgtcggccgcgaatgcagtcggctccgcgtgattgacgagcaccgggtagccgtagtcgtagtcgacttccgccgtgacgccgaagctctccgcctggcctttcgcgagcgcttcgatgcggcgcgcgagcagcgcgcgcacgtcggcgttcagtgcgcgcaccgacagcttcatcacgacggtttcgggaatgatgttgaaggtctcgccggcctgcacgctgccgaccgtgatcacggccgcatgctgcgcatcgacctcgcgcgcgacgatcgtctgcagcgcgaccatgatgctgcccgcggccgacatcggatcgcgcgcgaaatgcggcatcgcgccgtggccgccgacaccgcgcagcgtgatcgtcacacggtcggccgatgccatcgcggcgccggtgcggaaggccatgtcgccggccgcgcggcccggcatgttgtggatcgcgaagatcgcgtcgcacgggaaacggtcgaacaggccgtcgtccatcatcgccttcgcgccgccgaagttttcctcggccggctggaagatcaggttcagcgtgccggagaaccggcgcgtcgccgcgaggtggcgcgccgcgcacagcagcatcgcggtgtggccgtcgtggccgcacgcatgcatcttgttcgcatggcggctcgcgtacggcaggccggtggcttccgcgagcggcagtgcatccatgtcggcacgcagcccgaccgtgcgtgtgccttgcccttcgcgcagcacgccgaccacgcccgtcttgccgatgccgcgatgcacgtcgtaaccccagccggcgagcagctcggcgacgaggtcgctcgtgagcgtttcctcgaatgcgagttcggggtgagcgtggatgcgacgacgcacctcgaccagctcgggcgcgatcgcggcgataccggggatgacggggttcacggcttgcagcatggtctctcctgtggggcggctggggcgtttgacgcacatatgacgagcaagcatataaatttcttttgcgtaccagaagctgataaattgctttggtgctcaccaccggttgccgctcgggaataccctgagccggtgtgtgccgtgcagcacagggtttccacggatcacgcgtcgccgccatgaaataccatcagctgaaagcgttcgtcaccgtcgcggaagagggagcattcgcgcggccgcgcggcgcctgaacgtgtcgccggcggcactgacgaaggcggtcaaggagctggagatcgcgctcggcgtatcgctcgtcgtacgcaccgcgcgcggtgttcagctcaccgcgttcggccagcagttgcaggtgcgcgcgcggctgatcgtcgccgaaatgcagcgcgcccgcgatgacatcgagcaggcgcaaggggcgatgacgggctccgtcgcggcggcggtcacgccggccgccgcggtgacgatcctgcccgatgcgtttcgcgcgttccggcggcgttttccggtggcgcgcgtcagtatcgtcgaagggtttccgggcgtcgcgctgccgcggctgcacgacggctcgctcgatttcgcggtggccgtcgtcgtgcccgaactgctggccgccgagttcgatcacgccgaactgtattcgagccgttcgctgatcgtcgcgcgcaaggggcatccgctcgcatcggccacgtcgctcgccgatctcgtcgaagccgactggctgatgaatccgtcgcccgaaagctcgacgcaggtgctcttcaattcgttcgtcgcctacgggttgccggtgccggcgcgcgtcgtcgaatgcccgagcttcgggctcgcgcgcagcctgatgatgggctgcgacctgattgcctcgatgcccgagcagctgctgcagggcgagtgggcgcgcgaccagttcgcggtcctgccgatccgcgagcggttgccggccgtatcggtgcaggtcatcacgcgtcgcgacagcccgctgacgccggcagcggcgatgctgctcgattgcctgcgcgattccgcgaggcgcaaggggctgatgtgaacctgcgcccgtgggcagcgaccgtcgttgcgtcgttatcctgacgatcgggcgtgcggcgttgccgttgcccggcgggcacgtggcttgcgcagcgggcacgtcattgcggcgtctgccgcgcgagccggtatcatagcggccggcccgccgctccggccggcctccaaccacatcgccatccggcatccagcaatcagaggcatttcatgaccagtgcaacccaattcgacaacgtatcggtcgtcaagcgcgcgaacgtctatttcgacggcaagtgcgtgtcgcataccgtgctcttcccggacggcacgcgcaagacgctcggcgtgatcctgccgtgcgcgctcaacttcggcaccgatgcgcccgaattgatggaagtgcaggccggcaagtgccgcgtgaagctcgacggcagcagcgaatggcagacctacggcgccggcgaatcgttctcggtgccgggcaagagccgtttcgacatcgaagtgctcgagacgctcgattacgtctgcagctacctgtaagacgcgcgcagcaaagaaaagccccgccgaagcggggctcgtctaagcggatggcgcaaggccatccggagcgcctgttctcttacaggcaggcgttgatgtcgccggccgacgatgcgtcgccgccgcggaagccaacccacgtctttgcattcgcggcgttggccgggcgcacgacggccgcggcgccgttcggcggctgctggcccggcgcatacacggccatggcgaggccgttcgcgagttcatactgcgacgtcacttgttgctgcgacttgtcggcccaggtcttggcgatgcattgcgcgacctgatcggcgggcttctggctttgtcccacgttttggagggcagaatcggctgcatgagcagaaaatgccacggtcaatgcgatgagcggtaagtatttcgcgttcacgttatctccctcgagtcgtgattgattgagtgggatgcgcagcaggactgcgtgcaagtgagatcgcatcgaacaagcacggttccggctattccgaaacaagttgttaacgcgcttgccaaatggcgactccgatgctgtgcactttgctgcggcacggcatgcatcgtgtgcggttcgacgtcatgcgcggcgtggtcggcgcgctgcccggtcgtgtggtgaagtgatggtcgcggcgagcggcatacatgtgcatgccgtgccgcaactctttatttgatcgcgcagtggaatggctgattgatggccccgtcgcatgggcaccatgatgacaaactttcggccgtcgaattgttaaccaactttaaacagggaaagcgacggaatgcgaggcggcacgcgacgggcgtgccgcgtcgtgcgcagaggtgacgcgagcgggtcgtgcgcggcgagggtgccgcgcggcgcggtgggtcagccggccttgcgcgtgccgatgtcgcgcaggttggccgggacgatcgggcggaagcgctcgcgtttctgttcgtcgtcgaagtgctgcaacgcgggcttgatgaggtcgctgcgcgatacgatgcccgtgatgcgcatcgagtgctcgtcggcgacgacgggcaggcgttcgagcccgagcatcgcgagtcgcgatgcgacgacgcggcacgtttcgtgcgctcgggcaaccgccggcgcacgattggcgaacgcgcgcgagatcggcgtgtcgggtgcagcctgtgcgcgctgcgcatcgagcgtcgcgcgatcgacgagaccgagcaggcgcccgttctgcacgaccgggtacgcacggtgcgtctgcttcgcgccgaagtactgcgactcgacggcatcgagcgtcgccgcgccgtcgatcgtgacgagcaagtcggcggacgtcatcacttcgccgatgtcgtgccgctcgagcggatcgacgccgtattcgcgatagatgtgatagccgcggcgtgcgatcttttccgtcatgatcgagcgtttcatcacgatggtcgcgaagccgtgcgcgacgagcgtcgccgcgagcagcggcagcagcgcgttcgcgtcatgcgtgaggccgaacgcgaacacgatcgcggtgagcggggcgccgagcgttgcgccgagggtcgcggccatgcacacgagcggccacagtgtcggatcgccgcccggcagcatcggcgacagcacggtgccgaggccggcgccgagcatcagcagcggagcgagcacgccgcccgacgtgcccgagccgagcgcgatcacccacatcacggctttcacgatcagcagcgcgagcgcgatcttcaaggcgatgtgctggtgcagcaggtcgccgatcacgtcgtagccgacgccgagcgcgcgcggctcgagccagccgccgatgccgatcacgatcgcgccgagcgcgggccaccacatccagtgcaccggcagcttcgcgaaggtgtcctcgacgcggtacagcgcggccgacagcccgcatgcgagcaagcccgacagcaggcccgcgacgatgcacgacagcagcgcgacgggcgtcggcgcggccgtcgtcagcggaaacagcggatcgacgccgaagaacacggcgcgggcgaaacccgccaccgcgcatgccagtgcgaccggcaggaaactgcgcggacgccattcgaacagcagcagttcgaccgcgagcagcacggcggcgaccggcgtgccgaacacggccgtcatgccggcggccgcaccggcgacgagcagcgtcttgcgctcggcggcagtgacgtgcacgcactgcgcgatcagcgaaccgagcgcgccgcccgtcatgatgatcgggccttcggcgccgaacgggcccccgctgccgatcacgacgccggacgacagcggcttgaggatcgcgaccttcggcgacatgcggctcttgccgaacaggatcgcctcgatcgcttcaggaatgccgtggccgcggatcttttccgaaccgaagcgcgccatcaaccccacgatcagcccgccgatcaccggcaccacgatcacccacgcgccgagcgtgttgttcgcgggcgagcggtcgacgaacgagaactgctgaaagaagaacaggttcgtgaacagatggatcaggctcaacagcacgaacgcggcaagcgtgccgagcaggccgatcccggcggcaagcaacgcgatcctgggcaggcgttcgttggtcgagaaatcgcgtttgtgtggtgcgttcatcggcgtggaaaaagcatgggtcagtaatcgatctgcggaacctggaacgcgtccttgagcgacttcagctcggcgcgatgcatggccgcgaggcgggtgagcagcgtctcgccggccggctcgaggtgaacctcgacctgccggcgatccgcttcgctcgtcttgcgcttcacgaggccgagcgcttcgcagcgcgtgaccagcgcgacgactccgtgatgctgcgcctgcaggcgttccgcgagttcgccgatggtcgcccattcgcgatgcgggtagcccttgatgtgcagcaacagcaggtattgcagcggcgtcacgccctcactttgcgcggcgcgctcggagaagcgctcgaagcggcgcatctggtagcggaactcggacagttgctggaaatcgcttttcgtcagcgcgcgtcgggtatcgttcatcgggggcggtcggtcagtcggttacggtagcgtgaaatatatcacaacatgacataaatggccgaattcgtgcggataggatgcacgcctcgtagcaccggccgctacatggcgttacgagcgcggcatgcgtcaggcagcctcgagcatttgcgtctgccgataaaggcccgtgacgagatccgtctgggtaatgatcccgacgagccggtgcgattcatcgacgaccggaatgtggtagtggcccgaatgcgtcaacagcgggacgagcgcggtgatcggcatcgtttccggcacgcacgcgacgtcgcgtgtcatcaccgaggcgacgctcgccggctggccgccgaacgattgcggcagccgcgcggacaggcgttgccaccacggggtcgggcggcgcagcgggcgcgtgaggtcggcgcgcgtgacgatgccggtcaggcggccttcgccgtcgacgacgggcagcgccttcacgcgatggcggtcgagcagcgtgagcgcggccattaccgatgtcgacggcgcgacttcgatcgcatccttcgtcatcaggtcggcgcacgagagctggccgaacgtgcgtgtgtaggcctgcatctcggtttcgcgcagcagcgcttccaggtcgtccggatcgacgtcgagccattcgctgcggcgcttgagcaccgcgtcgaggtcgccgcgtgtgaagcggccgcgcgccggtgcggcggcgcccgcttgcggtttcgcttcggggcgcacgccgccgtgcgggtagcggtgcccggtcagcgtgtgataggcgagtgcggcggacagcaggatggccgattgcagcgcgatcggctccagcacgaagctgaacccgagcgaatggatcgcggggccgccgaccacggccgtgagcgcgacggcgcccgacggcgggtgcacgcagcgcagcgcgaacatgccgccgatcgcgcacgcgatcgcgaccgcggcggccgtgatcggatcggcgatccattgtgcgcaggcgacaccgaccgtcgccgcgacgagattgccgccgatgatcgaccacggctgcgcgagcggactcgccggcaccgcgaacagcagcacggccgacgcgcccatcggcgcgacgagcagcggcacgaggcccggtacgccagatagcacgcgcatggtcacgccgacggtcgcgatgccgacgagcgcgcccgtgcatgaacgcaggcgctcgcgccagcccagcgacatcggctggggaatgaagctgtgcagccattgccgcaacgtgcggcgcgacgaagggagcctgacgacatggacggtaagcggtaaagatgacagcgcgggcgcgcgcggcgacgagccgcgaattatatcgtgttgtgatataaattgtcgcgccgcatcaaggcggtgcatgtgcgtgacacgcatgtcttgcaaaacctttcatccgatgaaagtttatggtcgtggcaatagcgcaaatttgtctgtagcggcgtacaattcgggccactgaatcccccttcatgccagaaccacgtacgcgatgcccgctctcccgcctttctcccggcacggtgatcgattcgacgtggttcgcggctgcgttccgttccccacctgacgcgagcgctgccgacgcctcccactgactctcccaagctaattcaatggacatgctcgaaaacatgcgcctgttcgtgcgcgttgtcgaagccggcagttttactgcggtcgcgaaggaaatcgacgcgaccaccgcgcaggtgtcgcgcgcggtttcgaacctcgaagcgcacgtacagacgcgcctgctgcatcgcacgacgcgccacctcggcctcaccgaaagcggcgaacgctatttcgagcgcgcgaaatcgatcctcgcggaaatcgactacgcgaacgcggaggcgcgcaacgcactgctgcggccgagcggcaagatgcgcatccacgcgatgacggggctcgggcagagtcatgtcgtgtcgtcgatcgtccgctaccaggaggacaaccccgacgtgtcggtcgagctgacgctcgcgcagcggatgccgaatctcgtcgaggagggctatgacgtatcgatcgtgacggcgtcgcagcgcccgattcgggctacgtcgcgcagacctgcggcacgagctgcagcgtgctcgtcgcgtcgcgcgaatacctggcgcgccacggcacgccgcagacgcccgacgaattgccgaaccacgtgtgcctgcgcctcgacacgcccgcatcgccggccggcgaatggcggctcgagcgcagcgatggcgaggaggccatctacgagctgcagcccgcgccgttccaggtcaacgtgccggacgcgctgtgtcgcggtgcgcgccgggcgcgggatcgcgtgcgtcgcgctgtatacggtgctcgacgacatccgcgaagggcggctgatccgcgtgctgcccgagtatcggctgcagacggtgagcgtgtacgccgtctacgcgacgcgtcgttatctcgatgcgaagatccgcacgttcctcgaccacctgcgcacgacgctcacgcccgcgctggaggacgacctgcgcgaactcgaccggctgaccaccgaacagtcgcccggcggccgcaagcgcgcttgacgtcctgtggcctgggccgcgcatcgggtgcaatcgagtatggaaatcgtatcgatatcggtctaacgtccagagactatcgatcgattcaagaattgcatgattgaactgcaccagcttcgctgcttcgtcgcggtcgccgaggagctgcatttcggtcgcgcggcccggcggctcttcatgacccagccgccgctcagccggcagatccagctgctcgagcatgcgctcggcatcgcgctgctcgaacgcagcagccggcaggtcagcctgaccgcggccggcgagcggttcctgcgcgacgcgcggcacattctcgaattctccgcacgggccgagcaggccgcgcagcgcgtcgcgcatggcggcgccggccgcatcacgctcggcttcacggcggtcagtgcgtaccggatgatcccgatgctgctggcgcatgctgcgcacgcgctgccggacgtcgacgtcgaattgcgcgagatggtgtcgaccgtgcagatcgacgcgctggcgtcacggatgctcgacgcgggcttcgtgcgccagcgggccgcccgccagccgctcgaataccggctcgtgcagcgcgaaccgatgctggtcgcggtcgcggagggagcgccgctcgccgcgtgcgagcgcatcggccccgacgatctcgaccggcagccgttcatcgcgtattcgccgaacgagggaaatacttccacgacctgatctcgggcctgttcgcgaacgcgggcggctgccgaactacctgcattacgtcgggcagacgcatacgatcctgggcctcgtgcgcgcgggcctgggcgccgcactcgtgccggcgtcggcgcgcgaactgcatgtcgacggcgtggtgttccggccgctggcgggcaccgacgtggcggccgagctgtatctcgcatggcgcacggacaacgacaatcctgcgttgccggtgttcaacgcgatggtcgagcggtttctcgcgcaggagcagggcggcgcggtgacgtgatgcgccgggaatccgcccgggcgatgtgacaagctttcagtccggaagggggcgcatgcgatgacaagcaatcctgaccgagcacgacgggtcgcagtcctgcgattccttaccgtactgaaagccgtttcgctgccggtgttccagcggaggaacgcagcgcttcgctgcactgcgacaactgcttgacgctgcatgccggtcggcgcaggatacgtccgtgcatttggagcgggacgcgccggccgcgcggttcctgcacccgcgatatgcagaagaacaacgatgagcctttacgcactcgtaccggaataccggccccgcgtctgtcggcccgccggaaccacgcttctcccgacgcccgccgcgtcacgtatccgtcatcccgtttcgtaccgtgcctcggtacgctttcccgttcgcgcgcgagctgcgacgatgaacggcgcccgtccggcgcgccgcatcgcggcaccgtccgccatccttcattaccgcatcctgaacggcgcctacaccggcgtctcgtgacgcccgtcgcgcccgtccttgtattgcgccgccggctttgcctggctgcccggcggcaccgaagtccgaagcatttcgattgagcttgaaagagcacacgcaagcagttcggttcgaggttcaaggagaaaaactcatgtcgcagctttcgaatgaagaagcaaacggcagttcggggagtggcaaggtcaagctggtcaagtgggcgatcatcatcgccggcgtcgcgatcgcggcaccggccgcgctgttcatcctgaagggagtgatcgcgctggtcacggcgggcgtgatcggtctcggcgcgatctacttggcgccggtcgtcgcgatgaagttcgcgaaccagaaggtgaagatgatcgtcgaggaggcgcaggcgaatccgatcgagacgctgatcaaccagctcgcggaaaagcgccaggcggcacagaaattcgcggacagcatcaccgcgttccgtaccgaggtgaagaacttcgagaacaagacggaactgttcgagaagcagtatccggacgacgcgccgcgcttcaggcagcagctcgacacgatgaagcaactgctctcgttccgcgaggggcgctacaagcaggtgcaggccgagctgaagaacttcgcatcggcgatcgaccgcgcgaaggcgatgtgggacatgtcgcaggcggcgcagcagatgaacaagctcgcgggccggcaggcgtccgacacgttcgagcagatcaagaccgacgtggccgtcgattcggtgatgcgctcggtcaacaaggcgttctccgaaatggagacgtcgctgatggataaccccgaggtcaagcaggcgcagcagcaggcggtggcgaacgccccgcacgcgcccgggctcgacgcggcgaaccccgcgcaactgccgtcgaaacaacaataacttcctgcaggcacgcaaccatgaaaaactgcttggcgccatcgcgtttctggtagtgctcgtcggcgtatggatcgttcatcagggcggcctgtcgacgctgattcccgcgcatgacgcggccccggcctcgacatccgcgcaaaacggcgacagcggccagtcggcgcagacgccgccgtcggccagcgtgctgccggccggcttcacgccgcaggccagcacgctgaaatcgatcgccgaaaacggcatcgtgcggatctcggtgcagaacccgagcgaaccgttcttcggcgaggacaagggctcgccgcacggcttcaacgtcgagttcgcgcggctgctgttcgcggacccgtcgttctcgcatgggggcaagccggtcgtcgtcgatacgcgccacgaggtcgacacgtaccccggcgtgccgaaacaactgctcgataccgacgcgaaggggaaccacgtggtcgacgtggcgatggacgggctgacgttcccggacaacacgccggcgggcgtcgtctattcagtgccgtacgtcgacgatttcggctattcgctgatcgtgcggcaaggctccgcgatccgctcgaccgacgatctcacgggcaagacggtcggcatcctgaagggcgacccggacgtgcgtgcgttcgtcacgcgccagtatccgaacgcgaaattcgtcgaagtcgacgattccgatccggcattcatcgcgaagagcatcgacggccatacggtcgatgcgttcatctacgactatccgttcgcggtcagctcgatcaagggcaccgacctgaaattcgcggtgaccaagctcgacggctcgaacatcgcgtacaagatcggcgtgcgcgcggatgaccaggatctgctgatctacctgaacgccgcgatcgcgaagctcaagcagtcgccgcagtatctcgagctgctgcgcaagtacttcgtcagcgaccaggcggtgacgaccgcggccgcgtcgggcgaacacacgtacgtggtgaaggcgggcgacacgctgaacatgatcgcggcgagcaagctcggcagcggccagcgctatcgcgagattcaacgccgcaacaacctcgccaacccgaacctgatcctggcgggccagcatctcgtgattccggtgcgctgacggcggcgtgaagtgaacgaaaaggaagggacgtgaaggacggcgcgcggcccggcggaggtgattcgccgggccgcgcgcaggtgggcgtcagtgggtgatcgacaggaacaggtaggcggcgaacagcgacaggtgcacgacgccgtgcagcaccgtcgtgcggccctggctgagcgtcagcgtgctgacgagcagcgtcagtgccagcagcacggtttccatcgggccgatgccgagcgtgagcggctggccgacccagatgaacacggccgcgacggtcgggatcgtgagcccgatactcgcgagcgccgacccgagcgcaaggttcatgctggtctgcaggcgattcgcgcgtgcggcggtgacggccgcgagcccttccggcagcagcacgagcgcagcgatcacgataccgaccgcggcttcgggcgcaccgagccgcaatacggcatgctcgacggccggcgacagcagcttcgcgagcagcacgaccgcgacgaggctcgcgaacagcagcagcaggctgatcagcgcggtgcggctgctcggcggcgccgcgtgaaccgattcgttcgcgctgtcgtgcgcggtgaggaagtagtcgcggtgacgcacggtctgcacgaacacgaatgcgccgtacagcacgagcgacgacacgccggcgaacgcgagctgcgatttcgaaaagaacgggcccggtgcggcgttcaggtagttcggcatcacgagcgacagcacggacagggaagccagcaccgcgagcgccttgctcgcgccgcgccctggaagtcctgctcgccgtgcttccatgcgccgaccagcaggcagatgccgacgataccgttgcagatgatcatcacggcggcgaacacggtgtcgcgcgcgaggcccgatttctcggggccggcgccgagcatcaccgacacgatcagcgcgacttcgatgacggtcacggcgaccgcgagcacgagcgtgccgaacggctcgccgacccgatgggcgacgacttcggcgtggtggacggcggcgaacacggcgccggcgagtgcggcggcgaacaccgcgatgacgaggccttcggccggcacgacgcgcgacagcgcgaggaccagccatgcggcaagcggggccacgagggtccagcgcgggagctggttggacgagagcggcatggagggtttccttatgcgagtggcggcgcgcgacgcgccgtcacgggttgacgaagcccggccgtactatccgccgaacgagaatgatgaaaccgaaagatggcagcacgcaacggtgctgccctgggttcgccgccgtgaggcagcgaggggcgcgggcgggccggagcccgtcgcgggatgaaacgattcgatgcgcccgccgcaaaccgcgaggcgggcgcgtgagacgacgcgcgtgccggaggctcggttccgaccccggaagggcggccggcaatggacggcagtggcggcgtgacacgcggtttccctgaaatccggtggtttgccggattttatcaggcgttcggggtcgctatctcatattcgaacgctttcattgacctttcggtttgcaaaagtgccccgaacgttcgaatttttgtctttgcagtttccgtaacggtctcttgcacgacaaattcgggcacgccctgacataaatctaccgaccggtcggtttataatcgctcgcacttccacttcatgacggatcgcaagcgatggctgtttcttctgcacattcggtgaacccgggcgcgctggcgccgtcggcagtcgtcggcgtgatcggcgccggcgcgatgggcgcgggcattgcgcaggtcgcggcggcggccggccatacggtgctgctgtacgacctgaacgaagccgcttgcgacaaggcgctggccggcatccgcgcgcagttcgcgcggctcgcggagaagggccggctcgaaccggcacaggccgatgcggcaggcagccggctccgcgcggtgcgtgcgctggccgatttcgcaggtgccgcgctgatcgtcgaggcggccgccgagcggctcgacgtgaagcgcgagatcttcgcgacgctcgagcgccatgtcgacgacgcgtgcctgctggcgaccaacacgtcgtcgatttcgattacgtccatcgcggccgggctgcgcgcgccgcagcgcgtcgccggcctgcatttcttcaacccggcgccgctgatggcgctcgtcgaggtggtcagcgggctcgcgaccgcgcccgaagtcgcacaggtgctggttgcgaccgccgccgcgtggggcaagcagcccgtgatggccaaatcgacgccgggcttcatcgtgaaccgcgtcgcgcggccgtattacgcggaggcgctgcgcgtgctgaacgaacagggtggtgcgccggcgtcgatcgacgcggtgatgcgcgaggccggcggcttccggatggggccgttcgagctgatggacctgatcggtcacgacgtgaacttcgcggtgaccgaatcggtgttccgcgcgtacttcaacgacccgcgctacacgccgtcgctgatccagcaggaactcgtgaacgcgggtttcctcgggcgcaagtcggggcgcggtttctactgtatgcggacggcgcgacgccgcccgcgcccgatctcgaagccccgcgcgccgcgccggccgacgtcgcactgtttgctcaggacggcccggccaccgcgctgcatacgcgcttcaccgaacgcatcgcgggcgcccggcaggccggcacgcatgccgacgacctgctcgcgacggccggccgcgcgtcgatcgcgctgaccgacggccgcaccgcgaccgcgcgcgccgcgcagacgggcgtggccgatctcgtgctggtcgacctcgcgcgcgattacacgcaggccgggctcgtcgcgctgacgcgtgcgctccagtgcagcgacgcggcctatgcggacgcggtcggcctgttccagcaggcgggttttcgtgtcgtcggcgtcgcggacgtgccgggtatggtcgcgatgcgcaccgtcgcgatgctcgcgaacgaggcggccgacacgatgaaccagggcgtgtgctcgcccgccgatctcgatctcgcgatggagaagggcgtgaactacccgtgcggcccgctcgcgtgggccgatgcgatcggcatcggccgcgtgtttcgcgtgctgtcgaacctcgcggcgagctacggcgaggaccgctatcgcgtgtcgccgcgcatcgccgcactgcatgcggccggccgcacgttccggtcgtaacgccggcttcgtcacctcgaacacgataacgacatcactccattggaggagcaccccgatgatccacccgacgcatcccgccgccgccctcgagccgatcgagaccgccagccgcgacgaactgcaggcactgcagctcgagcgcatgaagtggtcgctgcgccacgcgtacgacaacgtcccgcactatcgccgcacgttcgatgcggccggcgtgcacccggacgacctgaagtcgctcgccgatctcgcgaagtttccgttctcgaccaagaacgatttgcgtgacaactatccgttcgggctgttcgcggtgccgcgcgagcaggtcgtgcgcgtgcacgcgtcgagcggcacgacgggcaagccgacggtggtcggctacaccgcgcgcgacatcgatacctgggcgaacgtgaccgcgcgctcgatccgcgcggccggcggccgcccgggcgacacgctgcacaacgcgttcggctatggcctcttcacgggcggcctcgggattcactatggtgcggaacggctcggctgcatggtcgtgccgatgtcgggcgggcagaccgagaagcaggtgcaactgatccgcgatttcgagccgaagatcatcctcgtcacgccgtcgtacatgctgaacctgatcgacgagatggtgcgacagggatggacccggccgagtcgtcgctgaagatcggcatcttcggcgccgagccgtggacgcaggcgctgcgcgaggaagtggagacgcgcgtgggcatcgacgcgctggacatctacgggctgtcggaagtgatgggcccgggcgtcgcgtgcgaatgcgtcgagacgaaggacggcccggtaatctgggaagaccatttctatccggagatcatcgatcccgtcacgggcgaagtgctgcccgacggcagccagggcgaactcgtgttcacgtcgctgacgaaggaagcgatgccggtgatccgctaccgcacgcgcgacctcaccgcgctgctgccgccgaccgcgcgcgcgatgcgccgtctcgcgaagatcaccggccgctccgacgacatgctgatcgtgcgcggcgtgaacgtgttcccgagccagatcgaggagatcgtcgtcgcgctgccgcagctgtcgggccagttccagatcacgctgtcgcgcgacggtcacatggaccggctcgacctcgcggtcgaactgcgctccgaagcggccgcgtccgtcaccgaaagcgatcgcgcggcgctcgcgcgcgagctgcagcaccggatcaagacgatggtcggcgtgtcgtccggcgtgacggtgctggcggccggcggcattcccgcgaccgcgaccggcaaggctcggcgcgtgatcgaccgccgccaggccgcgtaattccgatgtttgccgttctacccgaggaaacctgttcgatggatggattgaagaccctggccgtcacggtcgatgcgcgcggcatcgcaaccgtcgcgttgcagcgcggcgacgtgctcaacgcgttcgacgagacgatgatcgccgaactgaccgtcgcgttcaccacgctcggctcgcgcgacgacgtgcgcgcgatcgtgctgcgttcggacggccgcgcattctgcgccggcgccgacctgcagtggatgcagcgcgcgagcgcgaacgacgcggccgcgaacctgcgcgatgcggagcggttcgccgcgatgatgcgcgcgatccggcaatgcccgaagccgacggtggcgcgcgtgcaaggtcacgcgttcggcggcggcgtcggcctgtgcgcggcgtgcgacatcgtgattgcgagcgatcacgcacgcttctcggtcagcgaggcacgcttcgggatcctgccggccgtgatcgggccgtatctggtcgaggcggtcggccagcgccaggcgcggcggctcgcgctcaccgcgacgcagctcgccgccggcgaggcggtcgcgatcggcctgatccaccaggccgtgccgctcgagtcgctcgacgaagcgctcgaccggacgctcgccgaactcggccggaacggcccgaacgcgctgatggagatcaagcgcttcttcgacacgatcggcgagtatccgtcgtccgacgagcgcgcggcgttcaccgcgcagacgatctcccgcgtgcgggcgacgccggaagcgaaggaaggcttcgccgcgtttttcgcgaagcggccgccggcatgggaggcgggcgccgaataagcgcaagcggagacgatcggcggcgcaacgggcgagcccgcattttgcgccgcgggcgcttgctctacaatgcgtgaccccggcgccccgccggcccagccccgaccgattcttcatccgatgatcgtcaaccgccttatctccgagatcctgttcggcttcaccggcctgatcggcatcatcaacccgatcggcatcgcgttcctgtttctcgaacggaccgaggcgctcaccgaacacgagcgggacctgctcgcccggaaggtcgcgttcaactcgttcatcgtgctgctggtcgcgtttttcgccggcacgccggtgctgcatttcttcgggatttcgatggaagcgctgcggatcggcggcggcttcgcggttgccgtggccggctggcagatgctgaacgaacccgacgggccgggcggcggcgacacgccggtcaagccgatcgacgcgaacgcgatcatgacgcgcgcgttcttcccgctgaccgtgccgctgacggtcggccccggctcgatcgcgaccgcgatcgcgctgaacgcgaaccgcacgcacaagctgtcggagttcatgctgtcgagcatcgtgtcgatcgccgtgtccgtgctggtcgcggtcgtgatctggcaggtctacagccgctccgcgctgctgtcgcgctacctcggcagcgaaggcacgaaggtcgcgaagcgcgtatcggcgttcctgctgctgtgcatcggcgtgcagatcatgctgaccggcttttccgcgttcctgcagccgatcgccgaccaggccaagtaagcggcccgcccgcagcgcacgtcccgcgcagccggcgccccgcgcggcctcgctacctcgctacctcgcgacctcgcgccggcgaacgcccttcgtccgatgcggcgacgccgcacgtcttttgccgcccgggataccatgcgacggtccggccgatgcgcggcgcgcatccggccgtcagctcaacttcaatggcgaggcgtgcaatggaatacgtgaaattcggatcgacagggctggaagtgtccagcctggtgctgggttgcatgacattcggcgaaccgtcgcgcggctcgcacccgtggacgctgccggaagcggagagccgcccgatcatccagcgggcggtcgaagccggcatcaacttcttcgataccgcgaacatctattcggacggcacgtcggaggagatcgtcggccgcgcgctgcgcgatttcgcgaaacgcgacgagatcgtgatcgcgaccaaggtgttctaccggatgcggccggggccgaacggcgcggggttgtcgcgcaaggcgatcatgaccgacatcgaccagagcctgaagcggctcggcaccgattacgtcgatctctaccagattcaccgctgggattacggcacgccgatcgaggagacgctcgaggcgctgcacgacgtcgtgaaggccggcaaggcgcgctatatcggcgcgtcgtcgatgtccgcgtggcagttcgcgaaggcgctgcatacgtcgaagcagcacggctggacccgcttcgtcagcatgcagaaccacctgaacctgctgtatcgggaagaagagcgggaaatgctgccgctgtgcgcagacgaagggatcgcggtgattccatggagcccgctcgcgcgcggccgcctgacgcgcaactgggacgagtcgaccgagcggcagcagagcgacgcggtcggccagcggctttacgacgcgacggcggagtcggacagggcggtcgtcgacgccgtcgcgacgatcgcggccgcacgaaacgtgccgcgtgcgcaggtggcactcgcgtgggtcgcgcagaaggccggggtcaccgcgccgatcgtcggtatttcgaagccgcggcaactggacgacgcactggccgcgctcgagctgaaactgaccgacgacgagatcgccacgctcgagcgcccgtacgtgccgcacgcggtcgccgggttcgattgagcggcgccgccgcgcggccgtcagcgcgcggcggcgagcatcgggtaggtgaacagtccgaagtggacgacgttgagccccgcatgcgcgagcgcggacgcgagcagtccgccgcgccgccatgcgaggccgtagccgacgccggccaccgtgccgagcacgatccatgaccagccgccggccgcatgcgcggcgccgaacagcaccgcgccgatcgccagcgcggcccatggcccccacgcgaacgcaccgaacgcgcgcgtcagcccgccctgcacgtagccgcggaacagcgcctcctcggcgagcgtcacgagcagcaggttattgacgagccacagccagcccgacgccggccacttgggcgcccagccgaccatgccgaacgcgagcgcgccggccaggcacgcggccgccgtggcgacggccgccaccgcgccggtgcgcagcgcgcgcgacagcgggacgtccggggcgacccacggcagtacccacaccagccacaggccgacgagcggcttgtccaggttcaggtacatcgtgaacgggacggcatccggcgtgaagcgcgtcggggcgatcacgaggggattgtggaagccgggaatcaggtgcaggctgagcgcgaccgcgagtgcggcgaagacggcgtgcgcggcgatgcgcaccgcgtgcgggcgcccgggcatcacgccccaggcggccgcggccagcaacgcgagcggcgccagcgcgagcggcgcgagcttgccgaacgctagcgcgcacgcataaccgagcgcggcaaggccgacgctcagcccgtgctgcgggcgatgccacgcaaacgcggcggccgcgaacagggcgagccagatcgtggcggatggaaggagcgagagggacatgacaggagcggcattcgtcggacgagacgccgcgcatcatacagcagccttccggtcatgccggccgggagccgtcagcggccggcggtttcggtgacgccgtcgcggcccgggatgtggacgctgttgcgcacgcgcatccgccgccggtaccagaacgtccacgtcagcagacagccgaacacggtatagccgatgatcggcgacacgaccagcacgcgttcgaccggccaggtcacgaccatccagcagcgcagcagcatttccagcgtcatgaacccgccccagacgaaggtcatgcgccggagcatctgccgcagccccggctgcgcgttccagaccgcttcgaaatgcgcggcaccgccatccatctcgcgggcgatggtggcgcgcgcgagatagaagatcagcgggcgttcgcggaacagcgacagcaggaacacgacgccgatcgtgcctgacgcgagcgattcgcgcatcagcagcgtgcgtgcgctgccgccgaacgccattccgatgatcgacagcgcgatgccgagcagcacgatggccgccaccgcatcgacgcggcgcgagcggatgaattcgacgatcgaccagatgaccggcgggaccgccgacgcgtacagcgcgccggtttcgccgaaatacggctgcgcggcccggtaggcaacccagggcagcaccaggttgacgaagagttcgagaatcagtccggctcgcggtttcacggtgagcaattccacgcaggttggggcgaacgcgcaatgggtgtggtggccaccggttgccccgaaaagggttcggtccagtatatcgaagaatcgcgcggggctgcggcacggcttcggccgctttccgccggcaccgccggcaccgccggcacccatcgtcatggcgccgccgcggccggcagcgtgatcgtgatggtggtgccctgcagcacgacgctgtgcacgtggatgtggcctccgtgccgttcgacgacggccttgacgaatgccatgccgagcccgacgccgctggtttccggctggccggcggtgcggaagcgccggtagcgctcgaacagccgcgtctggtccgcgctactgattccgcacccgctgtcgcggatcgtgcagcgcacggtcttgccgtcggcgcccggctcgaccttgcattcgatgctcgtcagcggcgggctgtacttgatggcgttgtccagcaggttgatcagcgcgcgcgacagcagcgccgggtcgcccggcacgatcgtgtcgtcgcgccgctgcacgtcgtcgatcgacatggatttccggtgcgcgagcggccacaccgcatcgcgagcctcgttcatcaggtcggcgaggttgaccggcacgcgttcgtattcgctcgcctccgcgcgcgacagctgcgcgaaaccgtcggccatcgccagcgtgtgccgcgccagcctggcgattctcgcgaactgctgcttcatctgcgcgtcgcccgcccgctgcgcctgcgtgtcgatcaggatgatcagcgacgtcagcggggcgcgcatgtcgtgcgaaaacagcgtcagcatgtcgttgcgctggcgctcgagcatgtcgcggcggacggtcgcgttgcgcaacgtttccagcgacgcgtggatccgcgcgatctcgggcccgacgccgcgcggcatcgcgacgtgcgacgtatcgccttcgctgagcgcgacgatccggcggccgagcacatcgagcggcttcgacagcagccgctgcatgccgcgcgcgagcgaggccaggatcgcgatgcacagcgtcgtggcgaacgccgacaccccgaccctgatccgggcggcgttccggtcgccgatcgcgcgatgccgggcaaggtcgatcacgcggtcgcgcagcagctcgctcggccggaaatgcggcacgatcgcgcgggaaaaatcggcggcgctcatggcatacgcgccgtcccggccgccggcgacggtcgcgtcgacgagcggcaggatgttcgcgtcgaaggccgcgttgagctgcgcatattcgcgtgcgacgtcggggtcgtcgagctgcgcgccgatcgcgccgtcgatcagcgcgcgcaattgctcgatgcggccgcgcatccgcatgatgtccgcgagctgcacgcgatcgagcgcctgccgcgcgaacatcggcgcgatcagcagcgaacccgtgcgccccgcgtattcccggagattgccgaggagccgcgcgagcaggatcgcaccggacgtgcgcgggtcgcgcatcgccgtgtcgctcatcgcgccgtcgatcagcagcgacagcgtgtcgacgatccggaacaggcgcgcctgcgcgtgctggatatcgtgaacggtgcgtgacgcgagcggccgcgcgtcgagcgcatcgacttcggcacgcgcatcggcaagcgtcatccggacggagtcgagtgcatgcagcaggttgccgcgctcgcggtcgtcgagcacggctgcctgcgcgatgccggcgcgaaaacgttcgagcgcgttgtcggaacgcgcgcgcgcggcgagcaggttgcggatctcggcggcgccgtcgtcctgcaggcgcaccagcaggtcgttcgtcgggccgcgttcggccgagatcacgttggcggcgctcatcgcgccgcggacgaattcgaagctctgcaggtcggcgttttcctgccggtattgccggaaactccccagatgatcgtgccgcagagtaacgccagcagcgtggtgacgagcgcgaagccgatatgcgtcttctgcaggatcgtcagcgatcgaatgttgtatgcgtggtcccggctaaacgagaatgaacgattcatgacacaccatgtttgcaagctatcccgggtgggcccgtattctcggcctgtcggcgccgtgacgccgtaaggttttgtgggggccgccgccttcacgggcggccgcgatcccggccgggaggccggatctcgcgttgcacaggatcgccttgcgtcagtgccctgtcgacatcgggcgaatcgcgcttgatccggagaaaccctgatcgcgtatcggacccgtggcgcgctacggcagatggtttggattgcgaatattcgtgatccgcgcgtctgtcgtgaagtgcggcatcaggtccgcttcggacgacggcggcaaggagggggctggacgggaatggaaggcaggtgcgccgcccgtatacgggcgacgcttcaggacgatgctgcagcagccgcgcgagcggtcaggcgacggcgggctgaacgatgatcttcacgttacggtccttgtgattgaccagttcctcgaagccgtgcgagacgatgtcgccgagcgcgatgcgcccggtgatgagcggctgcacgtcgatgcggccgtccgcgatgaagcggatcacgtccgcgaactcgccgttgtatgcgagcgagccgatcacttccttttcggtcgacacgatgtcgaagaagttgaacggtgccggctcctcgaagatgccgaccatcaccgacttgccggccttgcggatcacgtcgatcgcgagcttcgccgtggccgtgtgcccgatgcactcgaacgacacgtcggcgccgtagccgtcggtcaacgccttgacttcggcgatcgcgtcggacgtcttcggatcgatgacgacgctcgcgccgacctcaagcgccttctgcttgcgcgcggccgacatctccagcgcgatcacgcgcccggcgcccgcggccttcgcgcacatgatcgtgcacaggccgatcgtgcccgcgccgaccacgacgacggtttgcccgacgatgttgccggccttcttgaccgcatgcagcccgaccgcgagcggctcgatcagcgcgccggcctcggtcgggaaaccgtcgggcagcttgtacagcaactcggccggcacgttcacgtattcggcgaacgcgccgttgttcatcagcccggtgaacgcgaggttctcgcagatgttgtacagcccgtgccggcaataccagcaggtgccgcaatgctggcatgcgtcggccgtcacgcggtcgccgaccgcgaagccggtcacgcccgcgccgagctcggcgatctcgccgctgaactcgtggccgaggatgcactggcccttcaggcccgtcagcggatgtggcgcgtcgaccgggatgaagacggggccggcgacgtattcgtgcaggtcggagccgcagatcccgcaccagtgcacgcgaatcgtgacccagccggccggcgggcgcgccggaacgggaacctgttcgacgcggatgtcgtggcggccgtgccagacggcggccttcatgctgggggcggtggtcgatgccggtgtactcacgttgctgtctccgtcaggttgtcgtcgggcacgcggcatggttggccggtgcgcccgttgcgcgattgcgcgatcgaccggtatgcaggaacggggccagctcgagcgggtacgccggatggcgattcaacggaacgtgcgtgatgcgatgcaccattcgcttgttccgttgacaggaaatgattcgacggggaggcgcgcgaaatttgctgcaactgctgaacggcacgccggtgagacgctgggacgtttgtctcagtgcaatgagacgaatcgcgagacgcgcggcgccgttcgacgcgcggtcaggcgacgatttcgtcgacggcgaccggtgcgagccgcgtgaatccggcggcgcggtacagcggcaggccggcctcggtcgacacgagccacacgcgctgtgcgccgcgctgccgtgcgtgcgcgacgatcgcggcgagcgactgcatcgcgagaccccggcggcggtacgcatctgccgtcgcgacgcggtcgacgacgatatcgtgcgccgacgcaaaaccgtagcgcgcggtggcggcgatctgcccgtccaggcgatgcgcgaacaggaacgcggccggattcggctggaatggcgggaacggggcgtccgcattgaacgtttcgatgtcgcgcggggtgtggcacccgagcgtctgcgcgagtgcatcgtcgccggacagtgtgtcgatatcggcggccatgaaatgctcgtccgacaaccggcgtgtcctgccttccagtgcgggcggcagcggcgcggcgccgtagcgcgtgatccacgcaccgacggtgaacgggccgtcgccatacgcgggcgcgccctcgatcacgaagtgctcgaaaggccgccccatgccggcgtcgaaccgcacgacctggccgtccgggccgtcgtgcagcggcgcatcgcgccggtcgcgtgcggcgcagtagccggcgacgaagatgcgcacggcggccttgcggcggggaaggtcgaccaggctgcgtcgagcggaagcggggcgtcgggagcgggataggcggtcggcatgcgtgcgcaacgtggtcggggcgaagccgacagcttaaatcaggcgaccgctcggcgccgcgcggggccattgccgcgatcggcgaaacggatcgttgcgcgcgatacccctttacttgaagttaacttcaatttgtatcatgtgcgccagtccgatcgcggacgcgtgacgcacccgttgcacgcggccgctccaacggaggtggagatgaccgaatcgcctgtcgcggccgatgccgcgacgctgccgtcgcgcagctaccgggccgccgtcgcgaacgtcgtgctggcgagcatcgtgtccgcgttgcacgtcggcaaggcgacgatcgcgttgccgtcgctgcagcacgagttcggcggctcgctcgcttcgctgagcgggatcatgtcggtgtttccgttcgtcggcgtgttcggcggcatcgcggccggcctgctggtacggcgctggggcgatcggcggatgctgatcgcgggcctggtgatcctcggcctgtcgagtgtcgccggcgcgtcggccggcagtttcgcgctgctgctcgccacgcgcttcgccgaggggctcggtttcgtgatcgtggtggtcgccgcgccggccgtgctgaatcgcgtgacgccgcccgagcggcgcaatctcgcgttcgggctgtggagcacgttcatgccggccggcatggcgctgtcgatgctggtcgggccgctgctcggcggctggcgcaacggctggctcgcggcttcggcgctgacgctcgccgcggccgccgcggtgcccgtcacgacgtccgccggtgcgccggcccggcaggccgcggcgccgcgcatcgggcccgcgctgcgcgacgtgctcgcgtcgcggtcgaccacgctgctcgcgctgggtttcgccacctacaacgtgcagttcttcgcggcgatgacgttcctgccggttttcctgatgcagcgcctcggcgtcgcggtcggcgcggcggggctgatcagcgcggcgatcgtcgccgcgtgcgtgatcggcaacctgacggccggctggttgctgtcgcgcggcgcacggccggggatcgtcatggctgcgacgtcggtcgcgatcggcgcggcgggcgcggggctcttcagcgcggccacaccggcaccgctcgcggtcgcgctgggtttcgcgttctcggcgatcgcggggatgctgccggcgacgatcctcgcgtgcgcgccgggctccgcgccgacgccgtcgctggcgccgctgagcatcggctgggtcgtgcagggcaactatctcggacaggtgatcgggccgctggcgatcggctcgatcgtcggtgcattcggctggtcgggcggcatcggactgatgctcgcggccgccgtcaccggtgcggcgatcggcctgtcgctgctgcgcgaaccgatgggccggcgctgagcgcggcgccgttcaacctgcacggaaatccgtcaagcatgctcaacaccatggaaagcctgatttgcgaagaagacgtgccgtgcgatgcgccggcacgggtcgaacacgatgcgatgccgccgcgcggcgccgcgcgtccgctcgcgacgctcggcggagcgcctgctcccgagcatgccgctgcggccgtctcgccgttgcgcccgcaattgttcgtcacggtgctggaggccggcgacgacgcgctgctggttcgctgggtcgagagcggccgttgccattacggcgaacagcgctggcgcttgcgcgtcgcgttgcagccgggccgttgcgcgatctccgggcagccgatcgagcccggcgagccggtgttccggccggtgcggcggccggtgccggccaatggcgacgagatgatctgcccggcgtcggtgcccggtgcaaccggcgcggcgtgtggcgtcacggcggacggtgacgacgcatacgccccggccgacgttcgcggctgaacgccggccggccgcggcatcacgtcatttcttcacgtcgtgccggtactggatgaacccggcgttgttcgcgagcttgtcgtacagcgcgcgcgcggtcgtgttggtttcgtgcgtgagccagtacacgcggctcgcgccggcttcgcgggcatggtcgtacacggcctcgatcagcgcaccgcctgcgccttgcccgcgtgcgtcgggcgcggtgtacaggtcctgcaggtagcagtacgggccttcggtccagcacgagcggtggtagatcgaatgcacgatcccgaccagcgtacccgatgcgtcgaatgcgccgagcacgaacatcggctcggcaggatccatcaggcgggcccacgtcgtcgcgaacaccgcgtcgctcagcgcggtgtcgtaaaacttctgataaccctgccacagcgggcgccatgcggcttcgtcggcggcgacgagcgggcgcaccgtgacgcgcgtcgcgtcgtgcgcgcggccggccgcatcgcgcgcgcgcgcctgcgcgtggcggatcgcggtgagcgactggcgctgctggccctgcgcgtcgaagttttccggtgcgagccacgcgtcgaacgcggcgcggacatccggccattcgccgtcgatgatcgagaaccacgcggtgtcgcgattgcggccgcggtagatgatcgcctgccggaacgtgccttcgtagcggaagccgagccgtgcggcggccttgcgcgacggcacgttcaggtcgtcgcatttccattcgtagcgccggtagccgagcgtgtcgaacgcgtacttcatcagcaggaactgcgcttcggtcgagacgggcgtgcgcttgagcagcggcgagaacgtgacggagccgacctcgatcacgccgttggccggatcgatgcgcatcagcgcgagcgtgccgaccgcgcggcccgtggcacggtcgatcaccgtgtagtgcagcggatccgcgctcgcctgcgcgccgcgcgcgtagtcgcggtagctcgactcgtcggtgtacgggccgtgtgcgagataggtccagtcgctgccgtccagcgcctgggcgtaggcggcgtacaggtcggccgcgtggcgctcggcgtcgagcggttcgagccggcagtagcggccttcgagcacgatgcgctccgggcgcgggcgcgcggaccagtcgggaacgggtggccgatggattgctggaaagcgttggtgagcgtggacaaggtcgatctcgcttcggttggcggccggcgacatgccggcatgcagacgatcgtagtcgtggcgaggtaccatgagaagcgccagagatcggcaaatttatggtgccacaagctgtgcgccgctggccgtgcgcaactagccgtccgccacgttccgacattttcacgctgcgatgttccgatgacgacaatcctgcctaccggcgacgcgccgttgctgccgctcgacgcgccgctggcgcgctcgccgggcgcgccttcgctgcagcgtcagttgctgcgccgcgtgcgcgacgcgattctcggcggcgcgatgccggccggcacgcggctgccaggcacgcgtgcgctggccgagatgctcggcgtgtcgcgcaacacgacggccgccgtctacgagcagctcgtcgccgaaggcttcctgcagtccgaccgccgcggcacgcgtgtcgtcgggttgtcgcggccggcgccgccgcgccggcgtgccgcgccgccggccgtcgcgcagcggctcggccgcattcgcccgagccgcatcggcaccggcgaaacggagggtttccggccgggcgtgcccgcgctgacgcacttcccggtggacgcgtggcgccacgcgatcgaccgagcgctgcgccgcagcggccgcgacctgctcggctacggcgatccgctcggcgagcgcgcgctgcgcgaatcgatcgcgcgccacctggccgtgacgcgcggcgtgcgctgcgatcccgagcagatcgtgatcacggagggcgcacagggcgcgatctcgttgtgtgcgcagctgctgacgaacccgggcgatacggtgtgggtcgaggagcccggctatcgcggcgcgcgcaccgcgatgcaggcggccgacctcgacgtcgtgccgatgccggtcgacgcggaagggctgcgcgccgaagcggacgactggcgcgagcggacgccgcgcctcgtctatacgacgccgtcgaaccagttcccgaccggcgccgtgctgtcgatctcgcgccggctcgcgctgatcgatgccgcgcgccggcatcgcgcgtggatcatcgaggacgactacgacagcgaattccgtcacaccggcgagccgatcggcgcgatgcacgggctcgcgcccgattcgcccgtcgtctatctcggctcgttcagcaagacgatgtttccggcgctgcgcatcggttttctcgtgctgcccgacgcgctgctggccgcggtgcggccggtgctgccggagatgctgcgcggcggcacgcgccacgtgcagctcgcgctggcggatttcatcgagacgggcgagtacggccgccatctcggccggatgcgccggctgtaccgcgaccggcggcggttgctgctcgccgcgctcgacggcagcctgagcgtgccgcaccagatcgagggcgggccgtgcgggctgcatctcgcgctgcggctgcctgcgcgctaccgcgatcgtgcgatcgtcgacgcggcgcgcgcccacggcatcgggccgttcccgctgtcgggcttttcgatcgatgcggcatcggcaggcaacgggctggtgctcggtttcggcaatacgtcggccgacgcgttcgagccaatgttgcggatgctgtcgtcgatcgcggagcgggtgggcggggcgtgacgtgcgtacgcgttgcctgagccggcggcgcggcgatcaggtgaaggaagccgccaacctttgactcgataccgcttctcggcggtcggtagcagcaagttcaccgctgccagcgggccgtttttcgtatatcgaccgcatgcagccgccgggttcggctccgcataccagcgcaaaccgcccaccgccgcacacgacaatcggacttgtgcggattgacgaattgccgactttgttcgaaacgaccgccatcgcggctccgcacttgccggccaccccggcatacgggtttcgattcgtatgttcgaacaggccgcgtggactataaatggatgcgtgtaccggtgcttgtcaggcgcctgcgcgtctcgcgcatgtcggcgccgcgactcccgggaggtgcaccgtggttcgccagacgcttgctcgcgccgtgcttcgcaccgcgttgatcgggggcgtgtttgccggctgtttgctgccttcgccggccgccgtttccggaaccctgtcgccatccgccacgccacccgcgacgaagcaaaggacgggtgcgatgccttatgcgatgccggtcgattttccggcgatcgtcgaccgctacggcccggcggtcgtgaccgtcacgaccgccgcacccgaccagcaggccggtgtccagtcgttcacgatcctcgatcccgacgatccgctcgccgcattcttccggcgcggcgcgccgcctcccgcgcagggcccgcagacgccggcgcccgacacggcgccgcgtgcggtatcgggcaccggctcgggtttcatcgtcagcgccgacggcctgatcctcacctccgcgcacgtggtcgacgatgcgaccgacgtgaccgttcggctcacggaccgccgcgaattcaaggcgaccgtgctggccgtcgatccgcaaagcgacgtcgccgtgctgcgcgttaccgcgacgaaactgccgttcgtgcgcatcggcgattcggcgaaggtacgcgcgggcgaaccggtgatgacgatcggcgcgccggacggatcgggcaacacggtcacggccggcatcgtcagcgcgacgtcgcaccggctgccggacggcagcgcgtttccgttcttcgaaaccgacattgccccgaaccccgacaactcgggcggccccgtattcaatcgcgcgggcgacgtgatcggcatcgcggtgcaggtgtatcgggcaccgaccgctacgcgagcatgacgttcgcgattccgatcgcgtttgccgcaaaggtgcgtgcacaactgcagaagcagatgcaggcgcagacgcagcagtcccaggagccgggcgagccgtcgtccggcaacgcgcttggcgtcgacgtgcaggatgtcggcatcgggctggccgccgcgttcgggctgccgcgtccggcgggcgcgctcgtcaacggcgtggcgcccggctcgccggccgccgcggccggcgtgaggcccggcgacgtgatcgtgaagctgggcgacaagacgatcggccgttcggccgagctgaacgacctggccgccgcgctgccgcccggccagaagacgccgctgcgcgtgatccgcaatcgtgcgccggtgaggctgacgatcacgggcgccgacgaggccgccggcaacgcgggcacgaccgtcggcatggccgcgccgaaggcggccgcacgaccggggccgggggcgggagcgagtgcgggcgcgggcgacggcggcgaccgcctcgggctgacgatgcacgcgctgagcgacgacgagcgccgctcgaccgggctcgcggtcgggatgatggtggacgcggtgcacggcccggcggcgaacgcgggcatccggccgggcgacgtcgtgctggagctcaacgacacgctgctcgagacgccggacgacgtgcagtcgctcgaagcgaacggcggcagcgtgatcgcggtgctgatccagcgcaacaacgcgcggaagttcgtgtcggtgcgtgcgcgttagggcgttgacgcggtcggtatcgtccgcctaccatcgtccggtatcgtccgacatcgcaccaagccagccaggcaaccaggagccatccggcatgaaagcagcaaccttcatcgtagtcgtacacaggcgcagggtccggtagcggcaccgcgccggcatccctgcgccccgactcgttcgggggctttttgcattgcgcacggccgtgcggcacgtgcgcggaggacatccgcttgcaaccgaacctgccgatcgcttccgaacgggcgtcgccgaggcacgcgacgctgatcctgctgtgcgcgtgctcggtgctgccgctgagcctgttcctgccgtcgctgccggcaatcgcacgtgacctgcgcgccgactatgcgctcgtcgcgctttcgctcggcggctacgcggcggtggccgcatcgctggagttcgtgatggggccgctgtcggaccggttcgggcggcggccggtcgtgctggcgagcgtcggcatcttcgcgctcggctcgctcggctgtgcgatggcgaccgatatccgggtgtttctggcatgtcggctgatgcaggcggcgatcacgtcggtttatccggtgtcgatggcgacgatccgggataccggcggcggtgcgcgcgcggcgagccggatcggctatgcggcgatggcggccgcgttcgcgccgatgctcggcccgacgctcggcggcgcgctcgaccagacggcgggctggcgcgcgagcttctggctgctcggcgcggcgggcgtcgcgctgttcgtctggtgcgggttcgatttcgtcgaaacccatgcggaccggtcgtcgagcctccggcagcgctgcgcgcgtatccggcgctgctgcgcgcgcgcgcttctgggcctacgcgctgtgcatggcgttttcgaccggctcgttctacgcgttcctggccggcgcgccgctggccgcgcaaacggtgttcggcatcgcgcccgcggagatcggcttctacatggggaccatcacggccggcttcgtgtgcggcagcttcctggccgcgcgttacgcgcgccgcttcgcgctggccacgacgatcctgtgcgggcggatcgttgcttgcgcgggaccgttgatcggcctcgcgtcgatgttcggcggcgcgactcatgcgatcgcgtggttcgggccgtgcgtgctggtcggcatcggcaacgggctgacgaatcccgtgcccatgccggcgcggtgtcggtgcgcccggcgctggccgggagcgcgtcggggctggccggtgcgatgacgatcgccggcggcgccgcgctttcgtcgctgacgggggcggtactgacgcccggcaacgcgggttatgcgccgctggcgatgatgctgctgtcggccgcgatcgcgctggcggcggctgtctgcgtgcgggtgttcgacgcgcgggacgccgggcgatgaacgcgaatacgcagcatcgccgcgccggatcgggcatcggtgcgggcatggatgcgggcaccgctaccgtgccgcgggcgattggcggacaatcgatcgaatatcgggagacgacgaacccgccgcgcgccgagcatgctccggcgcgcgaagggcggttggacgagggagcgatgagcgacttttctgatttccagcgagacattgccgacgccgcgagagcgacattcagggcgctgcgggcgctgcacccggacgagcatttctacgcgttcgcgctctataccgacagcggcgcgatgacggtggtgccggccgccaattcggtcgagggctgcgccgggtccgcgagcagcaggccgtcgcggacgacgacccgtggtatgcgtggggcttttcggaatgggcgtatgcggcggcggaagcgtcgccgttcaatgcgatctgcggcaagctcgccgatgacgtgctgagcccgcagtttgtccggtcgagattcccggaattttcgcggcaactgcacgccgacatgatcggtgcgctgcgcctgctcgaccgcgagggcctgttcggcaccggcgacgaacgggcggcgatcacgctgttcgtgtcgatcagcgacgacgacgcggccgaagcgttggaaaacgaatcggcgaaagcgctgaatccgccggccgtcgccgacgcattcctgcgccgctacgactgaccgaaatcgggatatcgcacggcggctccgcgcgggcggccgccgtgcttgctgcgtcacggcttatggcttacggcttcgcgcccacgacgaactcgaacgtcgcgacgccgtcgacgccgcccgtcacgcggtcgcccggttgcagcgcgccgacgccggccggcgtgcccgtgaagatcaaatcgccggccttcaactcgaccgagcgcgacacgtacgcgatgacgtcgggcacggcccagatcatgtcggccaggtcgccttgctggcgcgtgtcgccgttgaccgcgagccagatgcggcccttggccggatgaccggtggccgacgccgcgcgcagcgcggtcacggggcctgacgcgtcgaagcctttcgcccagtcccacggacggctcagtttcttcgcttcggcctgcaggtcgcggcgcgtgaggtcgacgccgacgccgtagccccatacgtgcgacagcgcgtcggccgggtcgatcgaccgcccgtccttgccgatcgcgacgaccagctcgatttcgtgatggaggtcgttcgtcagcggcggataggggacggtgcctctggccgggacgatcgcgtcggccggcttcgtgaagaagaacggcggttcacggtcgggatcggcgcccatttcgcgcgcgtggtcggcgtagttgcggccgacgcagaagacgcggcgcaccggaaagcgcgcggacgactggtcgacttcgacggaaggacgctcggcagcgtcgatgacataggcggacatcggatggcctcgttcggtgggaagacggatgccgcgcccgtgcggcgcacgggccggcatgcgtgcaacgatacccgacgcgcgtgcggccggatgcgacgcaactgcgttttaccgggacaaaactacgcgtcgggcgctgccggcgtgtcgtcgccatccggcagcgcggcgttcgcgtcgcggtacgccttcggcgacacgccgacccgcgcgcggaagcgccgcgcgaaatacccttcgtcgcggaagccgaccgagcgggcgatgtccgcgatgcgccggctcgtgtgggccagcagcgactgcgcgagcgcgatccggcgctccgtcacgagatcggtgaaggtgctgccggtttccttgcgaaccaggtgcgcgaggtagttgggcgacaggaacgcggcttcggcggtcgcggcgagcgtcaggtcctcgcgggtgaggttggcgcggacgtgccgcagcacgcgcgcgagcgcatcgcgccggccggcgcgctgggcgccgcgctgcgcgagcttgtcgagcgcgcccgcgtactgcgtgcagacgagcccgatcagctgcaacaggtagccgcgcagcaacgtggtcgagccgaacgtgcgcacgcgatcggtgtcgagcatgcacagcgcgaggcggcgcgcttcgtcgtaggtgtcgccggtcaggatgaagtcgaggtgttcctggaagcggaacggcgtcagctcgggaaagcggtgggcgggcacgtcctccaggtcgagcgggtcgacgtcgagatcggcgcgcaggaacgcctggctgaagttgatcacgatgaagtgcgcgccttccggatgcgggatcaggtgctcgcggtgcggcagcacgaacgcgagcgcgccgcgcgaaacggccgcgtgacgccaccgatccgctgctcggtgtcgccgccgagattgaactggatctggaaatacgcgtgccggtgcggctcggtgatcgcctggcgcgacgcctggtcgcggatgtagaagtcgagccggtcgctgcgttcgggcatcccgtacaggcgcggcggggcggtggagggcatgaaggattctgctggtcgtgacgcggttgagccgcgatggtacagcgaaccgggcgcgacggcgattcacgccaccttgcggcctggcccggaaccgctcgcggcgtgccgcgcggcggtcattcgtccgggtggaaaccgaggtagcgggcgtgcgggctgtcgccgccggcgcgccggcttgccccgccgaccgatgcgagcgcgtccaccgtcgtcgcgcggttcgagatcagcgtccacgcggtggtggcgtcggcgccggccggtgcggactccgatgtgcgcagatccgtcagcgcggcaagcagcgtggcagccggcggcgcgtggatcgcgaacccttcgttggccacggccgccgtgtcgatccccagcctctcgcacaaccgagcccgcagcggcgtttcggcttcgctcgccgcgcgcgagcgcgcgatgttctcgtgggtggccgcgtcgacgatcgtgccgccgcggacgaacggcgtttgctgccacgcgtcgggcgagcattgcttgccggccggtgccagcggcacgaacggattcacttcggccgggtagatccggcacacgagcggtcgctcgtcgtagatcgcgcaccgcaggtcgtcgcgcaggttcgggcacggccccgcatgggacgccgtgagcatgaccgtcacgcggacgggcagcgagccgctgagcgcggcggtcgagcgtgcgcgtttgtacgcggcgaacgcgttgtcgggctcgggctcgacgagccacggcatcgcatcgcacagcagctccacgtggccgccgcgttgcagccacgcggtggcctcgtcgatcgtcagcggaatgcgcaggtcgcggcagcatccgccgcagccgttgcaggcaaagtcgaggtcggtaggggtgtcgttcatgcttgattcgatacggatgacggggtgtcgcgaagcgtcgcgacacggcggtgatttcgtttaccgggcgaccagcggcgcgacccggcgccgcagctcgggcacgacgtcggcgtcgaaccagggtggtgcttgaaccacgcctggttgcgcggcgacggtgcggcagcggcagcacgtcggggccatagtcgcgccatgcgtggacggtgtccgtcagcgtggccttgcgcgcgtcgcgcaggaaatgccgctgcgcatactggccgatcagcagcgtaagccggatcgacggcaactcggcgagcagccggtcgatccacacggcgcgcattcggggcgcggcgggttgtcgccgctcgtgccgcggcccgggtagcagaagcccatcggcacgatcgcgaagcgggtttcgtcgtagaaggtgtcggcgtcgacgtcgagccagccgcgcagccgcttgccgctcgcatcgtcccacgggatgccgctcgcatggacgcgtatgcccggcgcctgcccgacaatcaggacgcgcgcgtcgcgatgggcacgcacgaccgggcgcgggccgagcggcaggtcggcttcgcaggcacggcacgcgcggatttcagtgagcagcacgtcgagcggcgcgcgcgtgggtttcggcatcgaatcggatcggggacggagggtcgtgcggcgctccggggccgcgcgccgggcgccgacaggcggcccggacaggcgtggcgcgggagcgcgcgccgcctgcatcatgcggcgcgcctcacgcccgcgacgggcccggtgcgccgctttcggcgacggcagcatcatacaacgcggtttgcgcgatcgcgcgggcgatcgccgcgtcgtcgtgcgaaccgtcgagcatgccccagcgccggtattgggacaggaaccactcgccttcgcgcggatcggggcggttcacggcgccgccgtcgtggaagcggatcggcagcggcggcacggcgaacggccccgatccgtagtcgccgagcaggcgcggcgcgatcagccgggccggcacgccgagcgcgtcgggcgacgcgagccagccggccgcctcgcgacggtgcgtggcgctgtcgagccacgcgcaggcatcgacgagcgtgcggatcagcgcgcgcgcggtggccggatacagcgcgacgaaatcgcgccgggccgcgagcaccttctccggatgatcgggccagatctcgctcgtgacggcgacggtccgccccgcgtcgcaggcctcggccacggcatgccacggttcgccggcgcagaaaccgtcgagttcgccgccggcgagcgcggccaccatctcgggcggcgggatcacgacgctgcgcacgtcgcgcagcggatcgacaccgtgcgacgcgagccagtggttcagccacatcgcgtgcgtgccggtcgggaacgtctgcgcgaggagcggcttgcggccgagcgtcgcgaacgcgtcgcgcacgctgccgctggcgcggtacgcgtcggcgaggctgcgcgacaacgagatcgcctggccgttgcggttcagcaccatcagcgcggccatgtcggcctgcgggccgccgatcccgagctgcagcccgcagaccagcccgtacaacgcgtgcgcggcgtcgagctcgccgctcagcagcttgtcgcggacggcggcccacgacggctggcggctgagttcgagcgtgaggccgtgccgcgcaccgaggttcaggtgctgtgcgacgatcagcggggccgcgtcgctcagcgcgacgaacccgaggcgaagatgcgcgcgttccggcgcgacgggagaggtggtgtccatggcgctcatgactggggtgatgcgtcgagcaactgccgcgcgacgtcgacgatgcgcaggccctggtccatcgcgcgcttgcgcagcgccgcatacgcgtcgtgttcggacagcctgcgctggtccatcagcatccgcttcgcgcggtcgatcagcttgcgttcggcgagttcgcgctcgacattggcgagccggcggcgcagcgcatcgtcgtgcgaagcgtgcgagcgcgacttcgagaatcggtgcaaggcgttcggccgacagcccttcgacgagatacgcgctgacgcccgcgccgactgctgcgcggatcagcgactggttggcgtcgtggctgaacatcagcacggggcgcggcgcggtcgcatgcatgaccgcgagctgctcgagcgtgtcgcgcgacggcgaatcggtatcgatgatcacgacgtcgggatgctgctcctcgacggcggccggcaggcgcgcgggcgtcgcgacgtcgttcagcatgtcgtagccgagctgcgcgagcgcgtcgccgagctcgccgatcggcttgtcggtatcggtgacgagcagcacgcgcaggcggggaggaagcgggcgcactcatgatgcgaacggcggcggcgaaatcgtggcgcgatgcgcggatcggaggcggcctcgcgcgcacgtcgtgccggtgccgcgcgcggcgacccggcagccggtgcgaacggcgccgctgttttcatgacaggtgggcggccggtgccgcgtggtgtcgcgcatgctacgcggcccgggagaaggccgtgtcgatcgcggccccggctgtgccggcgtccggcacctcccgcacggtcgtttcgccgatcgcgccgccgacgaggatcacggccggactgccgagccgtgctgcgtcgatgccgcgcgcgagatcgccgagcgtgccggtccagcggcgttcgtcgggcgtgccggcccattgcacggccgcggccggcgtcgatgccggcagcacggcgagcaggccggcggcgatgctgtcgacgcggctcatgcccatgtagatcgcgagcgtggtgccggtcgcggcgagacgcgcccagtcgggttcgccgtggtcctgacgatgggcggtgacgaacgtgacgccgtggcaatgcgcgcggtgcgtgagcgagatgccgaggctcgcggcggcggcgaaccccgacgagatgccgttgacgatctcgaccggaatcgcggcggcgcgcagcgtcgcgagttcttcgccggcgcgcccgaacagcagcgcctcgccgcctttcacgcgcaccacgtgcgcgccgcgcagtgcgtaacggcgcatcagcttctcgatgaatgcctggggcgtggagcggcaaccgccgcgcttgccgacacggatgacgcgcgcctgcggcgcgagttcgacgatgccgggcgcgacgagatcgtcgagcagcagcacgtcggcagcggccagcgctttcacggccttgagcgtgaggagatcgggatcgccggggccggcgcccagcagggtgactttgcctgtcgtcatgtcgtgttccagtgccgcctgcatgcggcggccgatagcgcgttgttgcgcggcggcggcgggcggtcgacgtatcggcatccggccgtgccgcgcacgggaggacgccgttgtcctgggcggcccgcctgcacgacgggcccggttttgagggactgcccaccggcgccgttgccggtgtcatgcagcgggttcagcaatatccgggccaaccggtatcgcccgtcgcgcccgcgcggcggaacggcgcgcatcgcgccgcgcgatggccacgtgcgggcgaaatgcgggccgagtatgggccgaatacgggccaattgcgggccaagtacggccccgtgcccgccggcggccgccgcgcgccggcagccgcaatgccgcatcggcgtgcatcgtgccccgcccgtgcgcaccgcgatgtcgcacggcgacagtgctgcatcgcaccacatctgtgcctcgctgcatcaccgcgcatcgtgcgccggctgtcgccgcgcgccgcacgacgccggacgagccttgcgcggcggggctgcgggcccgattcgcggcgacatggcatggcgtttgcgtaagccggttcgggcgaatcaatggcgattcgtccggcagtaccgattacagacgcgcccggcaacgggcttcatgggcaacggcgtcctacgcatcgggtctcgacgagaccgggtgcgcaggacgccgtttttcgtttggcggatgacatgaccgacaaagctacccgtatcgatctcttcagcctccgcaccgcgccgatgcgcgcgttccacctgacgtggatggcgttcttcgtgtgcttcttcgcgtggttcgcgtgcgcgccgctgatgccgctgatcgcacgcgaatttcatctgacggcggcgcaggtcgccaacatcaacatcgcggccgtggccgcgacgatcgccgtgcggctgctggtcggcccgctgtgcgaccgcttcggcccgcgccgcgtgtacgtgggcctgctgctgctcggcgcgatccccgtgttcgcggtgtcgttcacgcacgactacctgtcgttcctgatctgccggctcggcatcggcgcgatcggcgcgggcttcgtgatcacgcagtaccacacgtcggtgatgttcgcgccgaacgtcgtcggcaccgcgaacgcgacgacggccggctggggcaatgccggcgcgggcgcgacgcaggcgctgatgccgctgctcgtcgccgccggcctgatgctcggcttcggcgaggattcgtcgtggcgtatcgcgctggtcgtgccgggcgtcgcgatgctcgcgatggcctgggcgtactggcgcttcacgcaggattgcccgcaaggcgacttcgtcgcgctgcgcaaggaaggcgtgacggtcgacagcggcaagaagggcggctgggcgagcttcttcgcggcctgcggtaactatcgcgtgtggatgctgttcatcacgtacggcgcgtgcttcggcgtcgaggtgttcatccacaacatcgccgcgctgtactacgtcgatcacttcagcctgtcgctgaaggacgccggtttcgcggtcggcatgttcgggctgctcgccctgtttgcacgtgcgctcggcggctggctgtccgacaaggtcgccgcgcgccgcagcctcgacgtgcgcgcgatgctgctgtgcgcgctgatcgtcggcgaagggctcgggctgatctggttctcgcatgcgcaaagcgtcggcatcgcactcgtcgcgatgctcgcgttcggcctcttcacgcacatggcgtgcggcgcgacctacgcgctggtgcccttcatcgaccgcaaggcactcggcggcgtcgcggggatcgtcggcgcgggcggcaacgtcggcgcggtcgccgcgagcttcctgctcaaaggcgtcggcgacgtgcagcacacgctcggcctgctcggccttgccgtcaccgcgaccgcgctgtgcgcgatggccgtgcgcttcagcgaagaacacaaggcgcgcgaagccgagctgcgcgaccgcgcgctggctgccggcagcgtcgcgaactgatcgaccgagggaaacgtcatcatgaaactcatcgtcatcggccacgggatggtcggccacaagctgctcgagtgcgtcgcggcggaagcgggcgcgtcggcggcgctgcaggtcaccgtgctcggcgaggaaccgcgcccggcctacgaccgcgtgcacctgtccgagttcttcgcgggcaagtcggcggacgacctgtcgctcgtcgaacccggcttcttcgagcgtcatccgcagttcgacctgcgcctgaacgcgcgcgtcgcgtcgatcgaccgcgccgcgcatacggtcacgctcgcgtccgggaaacactcgcgtacgacaagctggtgctggcgacgggctcgcgcccgttcgtgccgccgatgccggggcacgatcgcgcgggctgcttcgtgtaccggacgatcgaggatctcgaggcgatgcaggcgtgcggcacgcacgcgaagcgcggcgtcgtgatcggcggcgggctgctcggcctcgaatgcgcgaaggcgctgcgcgacatggggctcgacacgcacgtcgtcgaattcgcgccgcggctgatggccgtgcaggtcgacgacggcggcggccggatgctgcgcgcgaagatcgaggcgctcggcgtgaccgtgcatacgggcaagaacacgctcgagatcgtcgacggcgaagagggcacgcaccggatggcgttcgccgacggctcccatctcgacgccgacatgatcgtgttttcggccggcattcgcgcacgcgacgagctggcgcgtgcgtgcggcctggaaatcggcccgcgcggcggcgtcgcgatcgacgacgcatgccgcacgagcgacgccgacatctacgcgatcggcgaatgcgcggcctggaacggcatggtgtacggcctcgtcgccccggctacgacatggcgcgcgtggtcgcgaagcagctgggcggcgacacgaacgacgcacctgcgttcgcgggcgccgacatgagcacgaagctgaagctgatgggtgtcgacgtcgcgagcatcggcgacgcgcacggcacgacggccggcagccgcacctaccagtacgcggacgagcgccgccaggtctacaagaagctcgtcgtgtccgactgcgggaagttcctgcacggtgcggtgatggtcggcgacgcggccgaatacggcacgctgctgcagatgatgctgaaccgcatcgagctgcccgagtcgccggaattcctgatcctgccgtcgtcggacggcgtcgcgaagccggcgctcggcgtcgacgcgctgcctgacggcgcacagatctgctcgtgcaacaacgtgtcgaagtcgcagatctgcacggcggtcgccgacggcgcgacgagcctcggcgcgctgaaatcgtgcacgggcgccggcacgtcgtgcggcggctgcgtgccgctcgtcacgcagatcatgaaggccgagatgaagaagcagggcctcgcggtcaacaaccatatctgcgagcacttcccgtattcgcgccaggagctgttccacctgatccgcgtcgagcgcatcacgaccttcgacgcgctgctcgcgaagcacggccatggcctcggctgcgacgtgtgcaagccggcggtggcgggcatcctcgcgtcgtgcttcaacgaattcgtgctgaagaaggaacacgcggggctgcaggattcgaacgactactacctcgcgaacatccagcgcgacggcacgtattcggtcgtgccgcgcatgccgggcggcgaggtcacgccggaagggctgatcgcggtcggccaggtcgcgaagaagtacgggctctacacgaagatcaccggcggccagcgcgtcgacctgttcggtgcgcgcgtcgagcagcgccgtcgatctgggaggaactgatcgcggccggtttcgaatcgggccacgcatacggcaaggcgctgcgcaccgtgaagtcgtgtgtcggctcgacgtggtgccgttacggcgtcgacgattcggtcggcctcgcgatcgacctcgagaatcgctacaagggctgcgcgcgccgcacaagatcaagttcggcgtgtccggctgcacgcgcgagtgcgcggaagcgcagggcaaggacgtcggcatcatcgcgaccgagaagggctggaacctgtatgtatgcggcaacggcgggatgaagccgcgccacgcggaactgctcgcgtccgacctcgaccgcgcgacgctggttcgctacatcgaccgtttgctgatgttctacgtgcgcacggccgaccggctgcagcgcacgagcgtatggcgcgacaacctcgaaggcggcctcgactacctgatcgacgtcgtcgtgcacgaccggctcgggatcggcgccgaactcgaagccgacatgcagcacgtggtcgacacctacgagtgcgagtggaagcgggccgtcaccgatcccgacacgcgcaggcgcttccgtcacttcgtgaacagcgatgcgccggacacgaccatcgaattcgtcgagacgcgcggccagatccggcccgcgaggcccggcgaacggacgggcggcaagcccgtttcgattcccgtcgtcgccgaaggcgtgatgcaggccgcaaccgaacccgccaccgtttgaccctgaccgacacccgtgtctttccaaggagcccatcatgaacgatcgtctgccgccgtcctggacccgcgtgtgcccgctcgacgacatcgtgccgaacaccggcgtgtgcgcgctcgtcaacggcgagcaggtcgcggtctttcacgtcgcgcatgctgaggaaggcggcgtgttcgcgatcggcaacgtcgatcccgtgtcgcaggcggccgtgatgtcgcgcgggctgatcggcagcctcggcgagcgcatcgtcgtcgcgtcgccgctgtacaagcagcatttcgacctgcgcaccggcgaatgcctggaggcgcccgagcagtcggtgagcacgtatccgtcgcgggtcgaggacggcttcgtgtggatcgcggcctgaccgccccggagcgcgcatgaccgccaccccgtcaagagcgtgtgcccgtactgcggcgtcggctgcgggatggtgctgcacgtcgaggaaggcgaagtcgtcaaggtgtccggcgacgccgaccatccggccaacttcgggcggctgtgcacgaagggctcgtcggcgcacgtcgcgctgcgccgctcggggcggctcgaccgcgcgttcgtgcgccgcgcgcgcgaggacgatctcgtgccgctgccggcgcgcgacgcgatcgccgacaccgcgcgccgcctgcgcgcggcgctcgatgcgcacgggccggacgcgctgtcgttctacgtgtcggggcagatgtcgatcgaggcgcaatacctcgtcaacaagctcgcgaagggtttcgtcggcacaaacaacatcgagtcgaactcgcgcctctgcatggcgagcgcgagcaccggctacaagcagtcgctcggcgcggacggcccgcccgggtcgtaccaggacttcgatcgcgcgaacctgttcttcgtgatcggcgcgaacatggccgactgccatccgatcctgttcctgcggatgatggaccgcgtgaaggccggcgcgaagctgatcgtcgtcgatccgcgccgcaccggcaccgccgacaaggccgacctgttcctgcagatccggccgggcaccgatctcgcgctgaccaacgggctgctgcacctgctgcatgcgaacggccgcaccgacggcgcgttcatcgacgcgtacaccgaaggctgggacgcgatgcccgcgttcctcgccgactacacgcccgggcgcgtggctgaaatcacggggctcgcggaagccgacctgcgcacggccgcgcaatggatcggcgacgcgcaggaatggatgagctgctggacgatgggactcaaccagagcacgcacggcgtgtggaacaccaacgcgatctgcaacctgcatctcgcgacgggcaggatctgccgcgccggcagcgggccgttctcgctgaccggccagccgaacgcgatgggcgggcgcgagatgggttacatgggccccggcctgccgggccagcgctcggtggcgtccgacgacgatcgccgtttcgtcgagcagctgtggcgcgtgccggccggcacgctgcgcaaggaaaccggcaagggcaccgtcgacctgttcgaacggatggcggccggcaacatcaaggcatgctggatcatctgcacgaacccggtcgccacagtgccgaaccggcagaacgtgatcgccggattgcaggccgcggaactcgtgatcgcacaggacgcattcctcgataccgagaccaaccgctacgcggacatcctgctgcccggcgcactgtgggccgagggcgacggtgtgatgatcaactccgagcgcaacatgacgctgatgcgcgcggcggttgcgccgccgggtgacgcgctgcccgactggcgcatcgtcgcggaagtcgcgcgcgcgatggggttcggcgatgcgttcgactatgcgtcggcggccgacgtgttcgacgaaatcgtccgcttctcgaatccggcgacgggctacgacctgcgcggcgcgagccatgcggcgctgcgcgacgggcccgtgcagtggccggtcgcgccgggcaccgcgcgcgaccggcacccgatccgctacctgaacgacggcgtgagccagccgctgcgcccggccgccgacggcgacgacgcgccgcgcatcgcgttcccgacgccgtcgggcaaggcgcgcttcttcgcccggccgcacgtcgatccggccgaattgcccgacgacacgttcccgatcgtgctgaacacggggcggctgcagcatcagtggcacacgatgaccaagacgggcaaggtcgcgatgctgaacaagctgaacccgcgcccgttcgtcgagctgcatccggacgacgcgagcgcgctcggcatcgccgcgaaggacagcgtcgagatccgctcggcgcgtggccgcgcggtgctgccggccgtcttgaccgagcgcgtgcggcgcggcgactgcttcgcgccgatgcactggaacgacgtgtacggcgacgacctgtgcatcaacgcggtgacgaacgacgcgatcgatcccgaatcgcagcaacccgaactgaaatactgcgcggtcgcgctgcggcgcgtcgagaccgctgcgttcgcgtccgccgacgaccggacggcgcaacccgatgcccgcgccgacgacgcacggcccgcgccggcgacggtgcaggcgactgcttcacaggaatccgacatggcagacatcgacactttcgcggccgcgctcggcgtcgccgacttcgcgctgccgccgttgacggacaccgaacggctgtatgtggccgggttcgtcagcgggctgaaggcaagcgccggccggcgcgagggcggcgtgccggtgctgccggccggcgcgccgctcacgccgccggtgcggttctggctcgacgggatgctcgcggggttgttcagccgctcgctgccggcgagcttgccgggcgccgcggcctccgcgctgccggccgatgccgccgcgtccggtggcgtgcggatcgtacgcgcgcggccgaaggtcgtgctgctgtgggcgtcgcagaccggcaacatcgaatcgttgaccgaggattacgcgacgcagctgatgaacgcgggcttcgagatccgcaccgcgtgcatgtccgactatccggtggcgtcgctcgccggcgcgcaatacgtgctgctgatgacgagcacgttcggcgacggcgacgcgcccgacaacggcagcgaattctgggaagcgctgcaggccggcagcgccgcgcgcctcgacggcgtgcacttcgcggtgctcgcgttcggcgaccgcaactacgaccagttctgcggccatggccggcggctcgacgcgcggctcgcggaactcggcgcggcacgcctgtgcgcgcgcgtcgattgcgacgtcgaattccagcgcgacgccgaccagtggctcgaacgcgtcgtcgcgcggatcaaggaggccgatgccgcgctgcacgcggtgccgtccggcggcctgggcccgtcggggctgctgccgacgaaggcgcatccggcgccgtcgaagctcgtcgcgaacctgcggctcaaccgtccgggcgcggcgaaggacacgcgttacgtgtcgctgtcgaccgaaggcgcgaacctcgaatacgaaaccggcgacgcgctcggcgtgtggccgaccaactgcccggaactggtcgacgagctgctgtccgtcaccgcgctgaaggccgatgcacccgtgtcggtggcgggtgtcggcgacgtgcgcctcggcgacgcactcgcgcgtcatttcgacatcacgcgcccgcatccggacacgctcgcgttcatcgcgtcgcgcagcgcgaacggcgcgctgaagtcgctgctcggcgacgaccgcaagggcgacctgaagcaatggttgtggggcaacaacttgcggacgtgctgcacgagtttccggtcgagctgtcgggcaacgaactcgtcgggatgctgaagcgcatgcagccgcgtctttattcgatcgcgtcgagcccgagcgcgcacccgggcgagatccacctgaccgtgtcggccgtgcgctatcacaatggccgacgcgcgcaaaggtgtcgcatcgacgttcctcgccgatcgcgcggacgacggccgcgtgcccgtgttcgtgcagaaatccgcgcatttcaggccgccggtgaacggcgacgtgccgatcgtgatggtcggcccgggcaccggcgtcgcgccgttccgcggtttcctgcacgaacggcaggcgcgcggcgcgcgcgggcgcaactggctgttcttcggcgaacagcatgcgcagacggacttctactacggcgacgagctgggcgcgatgcgcgacagcggttttctgacgcggctcgacctcgcgttctcgcgcgaccaggccgacaagatctacgtgcaggaccggatgcgggagcagggcgccgagctgttcgcgtggctggaggaaggcgcgcacttctacgtgtgcggcgacgccgcgcggatggcgaaggacgtcgatgccgcgctgaaggccgtcgtcgccgagcacggcggcatgtcggacgaagccgcgaacgactacgtcgcgcggctcgcgaaggcgcgccgctacatgcgggacgtgtactgaccgcgaacggtacggcgcggcgcgacgcggcccgccggtttgcgggcccggcgccgggcggcgcgtcggcctgcgacgagccgcgccgggccgtccgtcgggaaggccgtcgacggcgaacgtcgcacgcgacaggccgggcggcgggcacggcgttcctgcatgacatgaaccgccggccaccgccggtttgcgttactgctgacgctcccacgcgcgcgcctgttcggcacggacgaacgtttccgacgaccgcggcagcaggttgcggaacgcgccgccgtcgctgtcgatcacgtcgaccatcttcgcgatcatctcttccggatcgtgctgttcgagcgggaacgtcagccgctcgggcgtcaccgtgtggacggccggatcgtgccagcgccgcgtcgtttccatcatccggtcgttgaaacccgtgctgtacgggccggggttcacgaccgcgacacggattccgtgcggcgccagctccgcgtgcatcgcctcggcgatcgattcgaccgcgtgcttcgacgcgcaataggcgcccgtgaacggcccggtgatcaggcccgcgatcgacgacacgaacacgatcttgccgtgccggcgcgcgagcatcccgcgcgcgatgtgctgcgtgagttcgagcggcccgaacacgttgacgtcgaacaggtcgcggacgatcccgaccggcaggtcgacgagcgcgccggcttcgccgacgcccgcgttgttcacgagcacgtcgacgtccagctcggccgcgcgggcgcgatcgtcggccgacgtgacatcgagcctgatggcgcgcagcgtggtgccgcgttgcgcggcggcgtccgtcagtgcgtcgatctcgacggtgacgcgcacgccggccgtcacgtcgtggccgcgttcggcgagccgcagcgccacttcacggccgaagccggtgcctgcgccggtaatgaggatgcgtttccgtgccatgttgcttaccttgtggtgggaggggttgcctgaaagcggtcgcggccgtgccgggcgatcgcggtgtcttcgtcgacgctgccgcccgatacgccgatggcgccgacgcagcgtccgctgccgtcgacgagcggttcgccgccgccgaacgtgacgagcccgccgtggctgtgctcgattccgcgcagcggcccgtcgcccgatatcgcaccgagcgcgccggtcgatatgcggaagcggaccgccgtcagcgccttgcgctgcgcgagatcgatcgcgccgaggaaacagtcgtcggtacgcgcgaacgcgagcaggttcgcgccggcatcgacgattgcgatggcgacgccggcgacctgcagcgacgcggcatgcgcgagtgctgcgtcgatcgtacggcgggcggctgcgagcggcagcgcggcggtgagcgggtccatgcgaggctccggtgggacgacaggccccagtgtaggcaggtgcggtatatgggagaatccgcattccgctcgaaagagtttcaagtttttctaatgatgagccgacgcgatccgatggccgggctgcacgtgttcatgacggtcgcgacggccggcaacttcacgcgggcggccgctgcgctcggcctgacgccggctgccgtcagcctcgcgatcgggcagctcgagggcgagctgaacgtgaagctgttcaatcgcagcacgcgcggcgtgagcctgacggaggccgggcagcactactggcggcagacggaggccgcgtaccggcaggtcgtgcacgcgcgcgacgcgctgagggatgcgcgcagcgagccgagcggcgtgttgcgcgtcaccgcgctgccgctggcgcgcacgctcgtgatcgcgccggtgctggccgtattccgcgagcgttatccgaaagtgcggctcgagatccgctacgagaacgaactcgtcgacatcgcgaaggacgggttcgatgcggggattcgcctcgccgaccggctgcaaccggggacgatcggcgtgcggatcgcgccggcgctttcgtgtgcgctggtcgcgtcgcccggttatctggcgcggtacggcacgccggcgtcgatcgcggcgctcgaacgtcacgcatgtatccgcttccggttttcggagagcgggcggctgcacaaatggctgctgcacgacgggcgccgcgatgtcgatctcgatccggaaggcgtattcgtgacgaacgatgccgatgcggtgatcgacgcggcgcgtgccggtgtcgggatcgcgtttgcgttcatgcgcgagcgcatcgaacaggacttgcgcgacggcacgctcgtcgaggtgctgccgggcgcgtgccggacgctgccgccgatgtggctgtattacgtgaatcgcaagcacgtgccggcgaagctgcgcgcattcattgacgtgctgcgggagcgcgacggcgcaagcgcggcgtaagcgttgcgccggctgcctgcgtcgatttgcccggcggcgcatgatggcggttccagccacgaaacgatggagtcgcgtcatgacggtatctcttcattttccggttcgtactttggccattgccgcggcgctggtggcggccgtgacctgcaacgcgccggccatcggccagacatcgaccgtacccgctggttcggctgcggcgacgcccgacaatgcggtgctgctcaccgtcttcctgaaacacgatcagtcgcgcccgctcgccgagctgaacgcgcaattggcgaagcaggggttctacaaggcgtttccgccgccgggcgtcgaagtggtgagctggaccgtgacgatggggatcgggcagatcgtcgtgttgcggttgccggcatcgcgggtgcgcgaggtcaatcgggtgctcgaagatacggcgtggggtgcgtatcggacggagttctatccgacttacgactacaaggcgatcgggttggggagcatgaacgggcgaagtgaggttgaatattcaaaacagtcgcgtcaatggaaatgcgctgttctcggttactggaatgagtcgtcatttttaagataatgcagagctggagttctttgcggcggcgagggtggttgtttattcctcgaaaaatacgaaggcacactcggtatcctgataaagcggttaaacgaaacatattttgactatttcctgtgtgacagaccaggggccgacgttggtgcgattcgtacctgacgtgaaaacggtcgggaagcaatgccaaggaattttcgtcgattctgcgctggaggaagagaattggccgaagataaaaatgcaatcagacaagtcttaagtttgtgtgcttcacatatttacgacgcttggcaattgttcacattcatcctatggtttcctgacggttgatttgctaacgttcatcggcttaaaagacaccaatgtccgacgatgaacaagaagacctaccgcctggtgtattccaggctccggggaatggtggtggcggtcgaagagacagctactgccgcgggaaaaccgaatccggtgagagccgggccggccggcgttcgcgcggcagctcgggcttgctgatcgcggtcgcgtcgctggcggccgtgccttcgtttgcaccggcgcagatcgcgccagtgcccggcaccaccacccacgtgatccagacgcagaacgggctgccgcaggtaaacatcgcgaagccgtcgggtgcgggcgtgtcggtcaatacctacaaccagttcgatgttcagaaaaacggcgcgatcctcaacaactcgccgacgctcgtcaatacgcagcaggccggttacatcaacgggaatcctaatttcgggcccggacagtcggcgcggatcatcgtcaaccaagtgaacagcgcgaacccgtcgcagcttcgcggttacgtcgaagtcgccggaaatcgcgcggaagtggtgctggccaacccggccggcgtcgtcgtcgacggcggcggcttcatcaatacgtcgcgtgccacgctgacgaccggacagccatattacggcgcggacgggtcgctcgccggctacaacgtcaatcgcggtctcgtcaccgtgcagggcgcggggctcaatgcgacgaacgtcgaccaggtcgacatcattgcccgcgccatacaggcaaatgcagcgatttacgcgaagaacctgaatgtcgtcgcgggtgccaaccaggttgatcacgaaacgctgacagcgaagccgatccagggcgacggcgccgcgcctggcgtcgcgatcgacgtcggccagctcggcgggatgtatagcgagcggatttatctggtcggcacagagggtggcgttggcgtgcgtaatgccggggaaattcctgattttcttacaagtgccaataagattgggataagtcaggccgcagctcagcccgaaaatgtgttgcagaaacaaaaggagtagatcaatgatcgatggtctatggagtggtcttttgggtggatttttggggcctgttgttgcaaaaattatcgggaaattctcatattggaaggtttttgtattcatattggtgtgcatttatattttcatattcttggttgcaatatttaagtctggggttgagaaagggttttcgactgcagtggcgatttctttggggatgccagggcattggcgccgattgggtttgccgcggtttttgcattttgcgctttccttcaagtgcgttcgggtaagaagggttgatttttgagggatgggtggtttaaaataaattattgaagagatgaagattatcgagaattgctgggattgcttggctgcatttgattgtcaatatggtgctcattttttgatggggaggatgcgcatatatacgtcaacgactggcttggcgtgtttggtgcgatggaggacgatttttcaaaaagaatgaaggtggattcgttgggcattgtgttttggtatttagggagtgagtaaatttgattttgttgtgacgccatatgacagggttgatggaattgtgtcatggaaaaatccaatctcctttaactatgttggggagcgggttggcggcgaacaggtatacgagttggcaggaagtcttcatggatttgcatcgtcggtaggtatttatgtcgaatcgcgagggtttgagttgcatattttggcggaagatgagccatcgcgccgctcccatatatgattataggttttaaatttgacattgaatttgtgggtgttcgtggtgggaattgattaattatttggtcgtatttgtgagtcgggattgttggtgttgtgtgttgggtgtggctggtgaagttaataaatggaagacatagcggaataaatgcgagagacccaaaaccaccgcttgtcgtcgacctcgacggcacgctgaccccatcggacaccctgatggaatcagtgatccacgcggtaagacgcaagccttcaaacctgctgcgattgccattctggctcgtcggcgggcgcgccgcgttcaaggccaaagttgcagaacacgccgattttcgagctgagacactcccgtatcgcgaaccgcttgtcgactatctcgagagcgaacgcgaaagcggccgcaagatcgtgctcgcaactgccgcgcatcgttcgatcgccgagcaggtgagcgcgcatctcggtctgttcgatttcgtcatcgcaactggcggcgatacgaatctcaagggcgcgaccaaactggccggcattcgccggcaggtcggcgacgacttcgtctatgcgggtgacagcaaagccgatctgccgatctgggccggcgcgaaaggtgcggtcctggtcggcgttacccatggtgtcgcggcgaatgtccgcagccgcattccggttgaacgagagttttcgaacgtgcgcgcaggctttgccacatggtgcaaagcgctgcgtgtccaccagtggctgaaaaacctgttgctgttcgttccgctgctgactgcgtttgcgttcctcgacaccggcaaggttgccacactcgcgctcgccttcctgtcgatgtcgcttggcgcgtcggccacctacatcggcaacgatctctgggatctggacaacgatcgccgacaccctcgcaagcgcaaccgcgcattcgcaagtggcacgctgtcgattgtgcaggggctcggttgtgcggcactgctgctgaccctggcgtttgcgctggcatttgtggtgtcgcccgaatttgccggcatgtttgcgctctacctgctgctcacgaccgcatacagttggcgcctgaaatcgatcgtgctgctcgatgtcgtcgtgttgtcgttgctgtacacctatcgaatcatcgccggagccgtcgctgcggaaatcacggtcagccgctggttgctcgcgttttccgtatttgcgttcctgagcctcgcgctcgtaaagcgctgctccgagctggtgcttttgcgtcagcacaacaaacgcgcttcagcaggccgcgattaccgcgtgggcgatctcgaagtgctctggccattcggtatcggtgcatcgcttgccgcagtagtcgtcttcggccttttcatcaacgccccgagaccgccgcacgctacgcgattccgcacttgctctggttcgtgcagatcggcctgatctacttgttcggccgactctggatcaccacggttcgcggcgcgatgcacgacgatccgatcgttcatatcctcgaaaaccgcggcagcttcaccatgctttgcgtcatggtgacgatcgtgctggccgctcacttcctgccggcgccgtaagcggcgacaaccctatgacggaaaagaaccaaaaccgcgtgcgagccttctgccgtttcgccatcgtctacgtgctgctgttcatctgcgctggaaacatcacgaacagcatgctgctgaaatggggttttcgcgacgatcagaagggcgatttcgcaacgagctacagcctcgtcggcatgatgaacggcgacgcgccgaagccttatgtctaccggtcgtcgtttccgagtgccgccaagtggattgccgagcagcttgaccaggcaaagcaggacaagctgttcaaatcgatcaaacggcatgactccctgcgcaacgcttatttcacgagcgttccggaagaatactggacacctgtcacggcgctcgtctatcacctgacgtacatcgcgatcgtgctgtcgactctctttgcgcttctgctgatctataagctggcgaggctgcacggactcagcttcgggcgttccgtcggctttctggcagcgttcagtttcgtctatccgttgacgtttcagcagggcggctactactacgatttctttgaactgctcggcgtgctgggtgcgtgctacttcctgatcaagaggcgaatgctggcatgcacgctgatgattgccgtcttctcactgaacaaggaaacgtttttctcgtaccgctcgcgttgttcctgttgcacgagcgggacgtcgcaatgtcgaagcgcgttgcgtggctcgtactgcagctcgggatctgcatcgcgacccggcagttcatcatgagcggatacagtgaaaacgctggcggattcgtcgaatatcacgtgtgggacaacctgaagttctgggtgaatcccaaatcctatttgtccttctataacctcatcggcaaaggcatcttcacgccgagcctggaaaatccgctgatggtcgtgccacttgccgtgttcttccgggcagcctggcgagcgacgccgacgcgctaccgaagctacttcttcgcggcattcctgcccgtgctggtgctgttcatctttttcggctatcgggacgaggcgcgcaatttctcggtcgtgttccccgcgctcgtgttgattgcgctgcacggcgcgaaccggttcgacgcaattttcagcagcagtacagatacctcgggtgacagtcgtgtctcgcccaatcgtcggacggatatcgaggtggcgacggaggcggcgcgatgaactggctgatcgttgccgcgagtggcgtgttcggcgggctcgccagcgtattgctcagggttgccgcgctcaaggaaatctcacttggcgagtcggacgtactgccatggattgcacgcggtgccgccgttgccgcttacggcgcaggcttcgtgctttacgcggtcgcattgcgcaagacaaccctcggcattgcctatcccaccatggtggcgatctccatgctcgtcgtgctgtcgttcacagcaatgcatgagcatctattgcggccgatgcaggcggccggcgcatgcgtcatcctgatcggcgtttggatgatcacgcggtacgcgtaatccagagaaaccagcatatgaagaaaaatccgggagccaacctcgtcgcggcttcggtactgctcgcatcggccggagtcgcggcgcaatccgcttcgcctagcacgctacccgcaagcaatgatcagcgcgctcgcgagcaggaagaagcgcgtgaacgcgaaagaaccgtttctgctcctgcagttcgttcatcggtgaccgagcgtgtcgcgttcccgtcattgccgaccgaatcgccatgtttccgcatcgaccgttttgcattcgacgtacccgattcgctgcccgacacggtgaaagcccagggcgcgtccgcgttgccgatggatcgcttcgccttcgcgcgcgagtggctcggtcactatgaagggcagtgcgttggcaagcagggcctcgacgtgctcgtgaaagggctgtcccaggcgatccttgcgcgcggctacatcacgacgcgcgtgcttctgcccgagcaggatttgtccgcaggcacgctcaagctggcgttgatccccggcgtcatccgccacgtgagcttctccgacgagaaactccgcggcacctggaagaccgccttcccgacccgcgatggcgacctcctgaacctgcgcgacctcgagcaaggcctcgagcagatgaagcgcgtctcgagccaggacgtctcgatgcagatcgtccctgccgacacgccgggcgaaagtgacgtcgtgctcgacatcaggcgcggcaaaccctggaccgtcgtcgcctcgatcgacaactccggcacacgtgccaccggccgcctgcaaggcaacctgtcggtcggcatcgacaacccgctcggcctgaacgatatcttcaacatcggggtgagtcaggatctcgaactcggcgacaagcgtctcggctcgcacggctggaacggcttttattcgattccgtggggctactggactgcgacgctgtcggcctacacgaacacgtactaccagcagattgcgggtgtgaaccagaccttcgtcgcgagcggcaactcgaagaccatcgacttcaagctgaaccgcgtgctgtcgcgcagccagaacgacgtgttcggcgcgcaattccggctgtcgcgccgcttcggcaagagcttcatcgaagacacggaaatcccgcagcagcgccgcaacaacacgttcgtcgagatcggcctgaccgatcgccactactttggcggcgcgcagttcgacgggatgctcgcgtaccggcagggcatcggtgcattcggcgcgcaggacgacattctggcggccgaaggcggcccgacctaccgctaccggatggccgtgctcgacgcgaacctgcagatgccgttcgctattgcgaaacagccgtttcgctatgtcggtaccttccacggccaatacacgggcaacacgctgtactacatcgacgacctgacgatcggcagccgctatacggtgcgcggttttgatggcgagacgatgctggcaactgcgcgcggcttctactggcgaaacgagttgcagatgccgatcgggcagactgggcaggcggtgtatgcagggctcgattacggtcgcgtgtggggccgcagcccgtcgcgctggtcggcacgcaattggccggcgccgtgatcggtgtgaagggaagcgtcggtacgcgattcggcacttacgcgtacgacttgttcgcgggtacgccagtctacaagccgtcgagtttcccgaccgcgcgcgtgacgttcggcttccagctgacggcgcagttttgacggcgatggctatgtgacggaaagctggcgtagcccgccaagaggggaatgggctgcatcgatcaagagagcatgcggcatcagtaattggcagtatttagcaaatgaaggagagggaaatgaaaatgaatcgactgtatgcggcaaccgtgatcggggcggcggtactgctggcgggatgtggcggtggcgatggtgacggtagcggcgccaaggcaaccggtaacaccagcaacaacggctcgaccggcgcggcgaccgataccacgtcgaccgatcaaaccgccacattcaagtgtccgagcggctacaagtcgatacaggtgacgaagagcacgatcccgaatgcaacgatgacgctcgtgaccgacgatggcgtggcgacgtatacgttcaagacgccgcaggacggcgtggttcgtgacgggacggtgtgtctgggcaagcccgatccggttcccgcaggcgtgcaggccgatgtgatctacgagatcaagacgtatggcggtttctacgaaatgtccgaccggaaactgaccctgaacttcacgtcgaacctcattcccgatccgtccccgccggtgatcgagctggcggacgtatcgagcgggacggtcacgtacaagccggctattcagggagcctcatttcaactccgccgaatttcagcctgagtgtctatccgaacgctcccggtttgtatgtggtgcgcctgaaacgataagcaccgtgcccggccatggcgagcgtcccgtgtcgtcagaccgacgacttggcgcgttgagccgcggcagtcatggcgagcactgcttctttgatatcgggtcgcccaggcatccttgcacgtttgggcggcgaaggaccagcaagatatgacaagctggccgaaagcatttgaccccattcaaagaagcccgcccggccttgcgaattcgtgctcgtcgcggcgctccgcccggcagatttctcccaaatgcatcacaagtcattcatccgatgaaaaatccccgccggttcccggtatgatgcgcaccttgcgtttgtcgaacgccctatttttgatgcaattttgatgggcgaggccccacaaaaccgcacaatccgaagctgaaagattctgtaatataaattccgtatactcgtaagttctgatccaggcgccgcctgccatttcttcggccgaccgcccacgcagaacaaccagatacgtcgccgcctggccgtcttgcgccgcgacacgctatgcaccaccactgaacatctatgtcttcccgccactctggttcgcccggccgcgccgcggcggtgatcgcccgtgtccgggcgctgatccgcaacgagcgtgtgctgtcgccgctgctcgcgctcggcatcggcctgctgctgatcgtggttttccagcacctgtcggaatccgtcgactaccggtcggtgatccgcgagttgcgtcacatgtccgtcggcgagtggggcgcatcgctggccgcgacggccctcagctatctcgcgctcgtcgcccgcgatgcggtcggcctgcgttatgtcgccgcgaaagtgccgcgtgtcgcgttgtggatcggcgcgatcgccgggtccgcgctcggtaacgcgaccggcttcggcgcactgacgggcggcgcggtccgcgcacgcgtgtacggcgtgtcgggcgtcacgcccgcgcagatcggccggatgacggtgttcacgagcggcacgttggcgctcgcgatggtgttgatgacggcggtcggcatggtctgcgtgccggaggcgctcgccgcgatgctgcacgtcgcgcccggcgtgctgacgtggactggcgccgcgctgctcgtggtgctggccgcgatggtcgcgatgtgcggcagcacggcgcgcccggtcgtcacgcgtttcaagtggctgtcgttcgacgtgccggcgcggcgcgatctcgtcgcgcaggtcgtctatgcgatcctcgacgtcgtcgccgcgggcctgacgctgtgggtgctgctgccggccgcgccggtcggctttcccaccttcatcacggtgtatgcggccgcgctgctgctcgggatgatcggccatacgccgggcgggatcggcgtgttcgaagccgcgatggtcttcacgctcggtcgcgaagtgcccccgcacgcgatggtcgccgcgctcatcgcgtatcgcgcaatctacttcggcgtgccgctcgtgctgtcggccggcctgctggccggtttcgagggccgcgcgctgcgccgccggctcgtcacgcggcaggccgtgcgcgtgtcgcagctcgcgccggtgttcctgagcctcgtgacgttcgcggtcggtagcatgctggtgatctcgagcgcgacgcccgcgttctggcaccggatcgcgatcctgcgccacctcgtgccgctgtgggtgctcgaaggctcgcaggtgatctgcagcgtgctcggcgtcgcgctgctgttcgtcgcgcgcgggctgctgcgccgcctcgacggtgcgtggtggatgaccttcgcgctgacgctcgcaagcctcgcgctgtcgctcgcgaaaggcctcgcgttcgtcgaggccggcgtgctcggcacgctgctggtgctgctgctcgtcagccgccgccgtttcaaccgccattcgtcgctgctcgcggagcgcttcacggtgagctggttcgtgtcggtggcgatggtgctgatgctggccgtgtgggtgctgttcttcgcgttccgcgacgtgccgtacacgcgcgagctgtggtcgcatttctcgttcgacgcgcgtgcgccgcgtgcgctgcgcgcgacgctcgcagccggcgtgttcgtcgcgctgttcgcgctgtggcaactgctgcgcccggcgcccggccgtttcgtgaagcccgcggcgcaggacctgtcggatgccgaacggatcatccgcgcgcaggaatgcagcgatgcgggcctcgcgctgatgggcgacaagtcgttcctgttctccgaatcgcgccaggcgttcctgatgtacgcgaagtacggccgcacgtgggccgcgctgcacgacccggtcgggccgcgcgaggaatggcctgcgctgatcggcaagttcatcgcgctcgcgcacgcgcacagcggtcgtgcggcgttctaccaggtgcgcgccaacgcgctgccgctgtatctcgacgcggggctcacgctgatgaagctcggcgaggaagcgcatatcgcgctcgaccagttcgacctgaagggttcgaaccggtcgcacctgcgctacgcgctgcgccgcggcgacaaggatgcgctgacggtcgaggtgatcgcaccgccggacgtgccggccacgctgccggccttgcgcgacatctccgatggctggctcgacagccgcgacgcgcgtgagaagagcttctcggtggcggcgttccacgacggctatctggcgacgcagtcggtgatgctcgtgcggcaggccgacaagccgatcgcgttcgtcacgttcatgacgaccgacctcaacaccgaggcgacggtcggcgtgatgcggcacctgccggacgcatcgccgtatgcgatggaatatctgtttacgcagctcgcgctgcatctgaaggaagcgggcttccgcaagctgagcctgggcatcgcgccgttctcggggatgggggcggcgaagatgccgtcgccgtggcaccgggtcggcctgatggtctggcgcttcggcggccgcttctacaacttccgcggcttgcgcgcattcaagagcaagttcgaaccgcactgggagccgcgttatctcgcggcctcgggctcggtcggcgtgttcgtcacgctcgcggacctgtcattgctggctggaggtcggcgttcatgatgttgaagaagggaatcgcgcgggcggcagccgcctgcgcgggaatgatgctggccggcgccgcgtgcgccacgcagccggccgcggtgaaagccgaaaccgtatcgggcggccgctacgggcccgtgaccgtgaccaagcccggcgggcgctgcgcggcttcgtcgtgctgttctcgcgcgaggccggctggagtgcggccgaccagcaggccgccgatgcgctcgcgaaagccggtgcgatgacggtcggcgtcgattcggagcgttacgcgacgaatctcgccgcgaagcaggagacctgccaccacctcgacggcgacgccgaagcggtcagccaccagctcgaacgcctcgcgcaatcgtcgcgctatttcacgccgatcgtcgcgggcgtgggccagggcggtgcgatcgcaaagcagatcctgtcgatggcgccggagaacacgatcgccggcgtcgtatcggtcggtccggcggccaggctcgatccgcgcttcgccgtgcccgcccgatccgacgatcgtgcgccgcgcgatgccgggtttcgtcgaaacggcggccgcgggcgattccgcgaagctcgtgtcgctcgtcacgtcgcacctgcgggacaccaccagcagcgacgaactcgacgtgtcggatctgccgctcgtcgagctgccggccaagggcggcaacggccagctcgcgatcgtgatctcgggcgacggcggctggcgcgatctcgacaagacgatcgccgaggcgctgcagcgtgacggcgtgtcggtggtcggcatcgacagcctgcgctatttctggagcgagaagccgccggcgcaggtgagccgcgatctcgcgcgtgtgatgcgcacctacatggcgcgctggcatgcgaatcgcgtggcgctggtcggctactcgttcggtgccgacgtgatgccgttcgcgtacaaccggctgcctgccgacctgcgcgacaaggtcgccgtgatgtcgctgctcggctttgcgccggccgccgatttccagatccgtgtgacgggctggctcggcatgcccgcgagcgacaaggcgctgaaggtcgcgccggaaatcgcgaaggtgccgccgcagctcgtgcagtgcttctatggcgcggaggagaaggacacgatgtgtccggcgctcgtgaacacgggcgccgacgtgatcaagacgcagggcgatcaccacttcggccgcgactacatcgcgctcgagaagaagattctcggcgcgttcggcaagccggtggcggcgcgctgaacgccggcgcccgcttcgcggcgggcgccggccggaccttccggttcttcgtacgggcggccagcgtgccgcccgtttcattttgcggcgggcgttgccgcgttctgctgcggcatcgccgttctcgcatcgcgctgatagaagcccgggaaccggtcgagctgccgccgcgcggccgtgatgtccgtgccgtcgccgagcaccgcgctcgaaaacccggtgcgctccatcagcagcaactggtcgaccagcacctcgccggtcgcgcgcaggtcgccggcgaagccgtagcgcttgcgcagcaggtacgcctggctgtatgcgcggccgtcggtgaacgacgggaactgcaggtcgatgcgcgcggcctgcgcgatttgcgcggcaagcggcggcagttcctcgtcgttgccgatcgtcagcgtcgcggcgtcgtgccgctgcgtatcggcggcatgttcgaccggcgtcaacagccggatgcgttcggtcgggtgttctggcttcatgcgggctccacctgatggcgcgcgttgttcgccgcggccttgaagggttccgtgccgatgcggcggacggtgtcgatgaaccgttcgctgcggccgtcgctgtcgatccgcgcgtcgaggtacgcgttgacgatcgcttcgacgacatcgacgatctcgtccgccgaaaacgacgggccgatcaccttgcccggccgcgccgggccgctcgcggtcgagccgtccgagccgccgagcgtgacctggtaccactcggcgccgtccttgtcgacgccgaggatgccgaggtggccgctgtgatgatggccacacgagttgatgcagccgctgatgtgcaggtcgatgtcgccgacgtcgtgcagcatgtcgagatcctggaagcgctcggcgatcgcgtcggcgatcgggatcgagcgtgcattcgccagcgcgcagaagtcaccgccggggcacgcgatcatgtccgtcaggagtccgacgttcgcgctggcaagcccgatcgcgcgggcgttttcccacagcaggaacaggtcgtcgacatgcacccacggcagcacgacgttctgcgtgtgcgtgacgcgcgcctcgcctgccgagaagcggtcggcgagatcggcgagcgcatcgagctggtccggcgatgcgtcgcccggtgcctgcaggcggcgcttgaacgacagcgtgacgatgcgcagcgccgggtcgcggtgatcggcgacattgcgtgcgagccagcgcgcgaaggccggatggtgtgccgcctgggccgacacgcgcaggttcgcgtcgcgcaggctgaccgtgcgcggcttgaggagcggcgcgacgaacgacgcggcgacgcggtcgaactcgacctgggagatcgtgtgcagcccgccgtcgtgttcgacgatctggcggaactcttcctcgacgtcgtcgatgtagcgttgcccttcggtcttgacgaggatcttgatgcgcgccttgtacttgttgtcgcgccgtccgtagcggttgtacacgcggacgatcgcctcgatgtagttcatcacgtgctgccagggcaggaacgcgcgcagcagcgtcgcgatcgtcggcgtacggcccatcccgccgcccacgctcacgcgaaagccgagtgcgcccgtatcgtcgcgcacgagcttgaggccgacgtcgtgccagtcggtcgcggcgcgatcttcggccgccccggtgatcgcgatcttgaacttgcgcggcaggaacgcgaattcggggtgcagcgtcgtccactggcgcatcacctcggcgaacgggcgcggatcggcgatctcgtccggcgcgacgccggcgcgctcgtcgcacgaaatattgcggatgcagttgccgctcgtctggatgccgtgcatgtcgacggtcgcgagcaggtccatcacgtcggcggccctggcgagcggaatccagttgaactgcacgttggtgcgcgtcgtgaaatgcgcgctgcgggtcggcaggcgcagcgtgccgagcagggcctgcgcgtcgcatgcggcgcggtaggtggcgtcgtcgggcacatcgtagtcgcgcgcgatccgcgcgagcacgcgcagctgcgcgctggacagttcgccatagggcacggccacgcgcagcatcggcgcgtggcgctgcacgtaccagccgttctgcaggcgcagcggccggaacgcgtcttcgctcagcgtgccgagctgccagcgctcgagctggtcgcgaaactgggcggcgcggctgtgcacgagcgcccggtcgaaaacggtatatcgatacatgacgtgatacgcgagaggagccacggcacgatgcgcacggctcgggagggcgttgcgacgggtgtcaggcaaccggagacagcgtagggaacgcggggcggcgggacaagcagcagatcgggacgaaaagggcgcagcagatggccggcgagaggccggtgccggccggcgcgggtcgggcatgcgtgcatgcccgtgacaggcttacgcgtcggcgtcgacgacgagcgccggatcgagcgcgcggatgcgctggtcgatgaagtagccgccgccttcctggtagcgcaggaacagccggccgcacgcgcggcagcggctcacggtgcagcggttgtacgggaaatggcgcagtgcgatcggcgcgtcgtccgacgcgtagcgcgtgccggccggatgatattcggcgtaggtcggctccgcctcgccgggcggcgtgagcgtggcgacttcggtcagttgcgcgtcctgcagcgacagcggcaaggtcgtccatccggcgagcggcgttttcgtgcaggtgcacggctgcgtgacgtgcgctgcttcggtggccagtttcaacagcgcgtcgtgatcgaggtagggcagttgactcatgggaagtcatgaaggggcggcgggatcagcactgtaacccgcgcacgggttgcgtgcagggtcgtgacgcaggcggcgcaccgtgcgcgcttcaagcgcccttgcggaccgacggctgcgcgaccagttcgccgagcacgcggatcgcgcgttcgatgtcgcggctccacggatggccgaagttcacgcgcacgcaacgttcgaagccgtgcgcggccgaaaacagcggccccggcgcgaaactgatcccgcgtgcgatcgcctggcgatgcagctccatcgcgtcgatcgcgtcgggaaacgcgagccacaaaaatagccgccttcgggccgcacccactcgacgccggtcggcagccagcggcgcagcgcgtcgtccatccggtcgagctgcgtgtgcagcgcgccgcgcagcttgcgcaagtgccggtcgtagccgccgtgctcgagatagttcgcgatgccggcctgcgcgggaatgctggccgacagcgtcgtcatcagcttgagccgctgcaccttctccgcgaaccggccggcggcggcccagccgatccggtagccgggcgcgagcgtcttcgagaacgagctgcagtgcatcacgagtccgtgccgatcgaacgcgcgcgcgggcagcgggtagtcggggccgaaatgcagctcgccgtacacgtcgtcctcgatcagcggcacgtcgcgtgcggcgagcaattcgacgagcgcacgtttttttcggtggacagcgtgacgccggtcggattctgaaattggtcatgaaccagcacgcgcgaatgtcgtgccggtcgagcgcgttcgcgagcgcatcgagatcgaggcccgtgcgcggatcgacgggaatctcgaccgcgcgcaggtcgagccgttcgatcgcctgcagcgccgcatagaagccgggcgcttcgacggccacgacgtcgccgggccgcgtgacggccatcaggcacaggttcagcgcttcgagcgcgccgttcgtgacgacgatctcgtcgatgggctgcgagatgcccgtcgcgagatagcgccgggcgatctgctggcgcagcgcctcgttgccgggcggcaggtcgacgaccgtgctccacgggctgacgagccgcgtggcctgcgcgagcgatttcgcgaggcgaggcaacgggaacaattgcggcgacgggaatgcggagccgagcggcacgatgccgggctgcgtggccgcgtcgaggacggagaacacgaggctgctgatgtcgaccttgcgcgtggcgccggcccgtctcgcgcggcgcgtgggcgccgggcctgcctccggcgttgcgcccggcgcgacgtagtagcccgagcgttcgcgcgcacggatcagccccactgttcgagcaggtagtacgcgcgaaacaccgtcgactggctcacgccgtgctgcgcgatgatctgccgcagcgacggcaggcgcgtgccgacggcgaggttgccgttgcggatgtcgtcggcgatcgtatgggcgagggtttcgtagcgtttcatcggcgagggtagcgcgcgccgtcgccgcgcgcgggccggactggcgccgcgccggcgggcgcggctcattgtccgatgcgcggcccgaaaggaaagtgcacgcgtgtcggccacgcgttcctgccgtgtcaggccgcgttcggctccacgttccgccgcttcgcatcgccgcgcagcggcggcagcggctcgaccttgccgacgatgaacaggtacgacagcgcgccgaccacgcacaacgcgccggccaccgcgagcggcacgacgaacgagcccttcgtgatcgacagcatcacgcccgtgaacgtcgtgatgaagatccccgcgagattgcccgcgaaattctggatgccgccgagcgacgcgacatgcgccggcgtcggcgcgacttcgccgacgagcgtccatacgttggcgcccgcgaacgacaggctggcatacgcgagcgcgaacagcgcaaggcacgcccagacgttctcgacaaaggccgacagcgcgatcgacgaagacagcagcatcccgagcacgaggcaggtcttgcgcgcggcggtcgcgctccagccgcggcggaacaggctgtccgacacgtagccgccgagccagccgcccggaatcgcgagcagcgcgggcagcatgccccacgtgccgagcgacgcgagcgagaagccgcgcgactgcagcaggtagctcgggaaccacgtgatgaagaagtagatcgcgaagttcaggcagaacaggccgatcatcatgccccacacggtgcgatagcggaacaggtcgagccacgacaccttcgggccgttggttgcggccgcaacggccggtgcgccgcgctgcgcgagcagggcatcgacggcgtcaggcgcgatcgcgcgatagcgttccgggtcgcgatagacgaaccaccacgccagcgcccacacgatgccgatgccgcccgtgatcacgaacgacccgcgccagccgacgatcgagatcagccacgcgacgagcggcagcgacagcgcggagccgacgcgcgagccgctgtcgaagatgctgctcgcgagcccgcgttcgctgcgcgggaaccagttgaacgcgaccttcgcgaacgacgggatcgcggccgcttcgccgacgccgagcatcagccgcacgccgacaagctgcgcgaggccgcgcgcggcgcccgtcgcgacggtgaacaccgaccaccagccgaccgcgagcgcgaggctcacgcgcacgccgaccttgtcgatgaaccagccggccggcaactgcaggaacgcgtaggtccagaagaacgcgctcagcacgagccccatgccgaccgcgtcgaggccgaggtcggcgcggatgctgggcgccgcgatcgcgaggttcgcgcgatcgatgaagttgatgacgttggccaggaagcacatcaggatcatggcccatcggatgcgtggcatggggtgtctccgcgcggaatgtcgtgacgggcggccggcgatccgctgcgccggctaccgcgatgggcgggttatcgcgtgactggcgacggcgtgcggtcgaacttcgcgagcgcttcccacaggccgttcaggtagaccgcgccgagcgcgcggtcgtagaggccgtagccgggcttgcccgtctcgccccagatcatgcggccgtggtcggggcgcacgtagccggtgaagccggtgtcgtggtacgccttcacgatcgcggcgatgtcgagcgagccgcagctcgacaggtgcgccgtttcctcgaaatcgccgttcgcgtcgaccttcacgttgcggatatgcgcgaagtggatgcggcccatcgcgccgaattcgcgcacgagcgcctcgacgtcgttctgcgggcccgcgccgagcgagcccgagcacagcgtcagcccgttcgcgggcgtgtcgacgatgcgcacgatccgtgcgagatcgtcgcggttcttcacgatgcgcggcagcccgaagatcgggcgcggcggatcgtcggggtggatcgccatcttcacgccggcttcctcggcgaccgggacgatcgccttcaggaagtattcgaggttcgcccacagcgccgcctcgtcgacgtcgcgatactcggcgagcagcgcccgcaactgttcgggctggtagctcgaatcccagcccggcagcgcgatgccgtcgtccgatcgatccggtcgaccgcgtcggtgctgaacgcgaggcaggtcgagccgtcgtcgagcgtcttcgacagctcggtgcgcgtccagtcgaagacgggcatgaagttgtagcagatgacgcggatgccggccgcgcccagatggcggatcgtctgccggtagtggtcgatcaggcggtcgcggcccggtttgccgagcttgatgtcctcgtgaacgggcaccgattcgacgacttcgaactgcaggccggcgcgttcgatcgtcgccttcagcgtgtcgatcttgtgcgcgggccagacttcgcccaccggttcgtcgtagatcgcggacacgatatgcgtgacgcccggaatctggcggatgtattgcagcgagaccggatcggactcgccgtaccaacggaaagacatcttcactggagcggctcctggctggcggttcatgcatcgggcgaccgggcggcagtgtgccggcccgtcgtcggtgtgcggattatgattggtatgccagttgtgtgggatagtggtttaccagttgtccgattcaggattggccggaacgacgcttccgggagcgtccagtcgagctggccgacaggccgaaccggatgcgggccggaattggtgtaccattttgcgatccggcgccgcgacggcgccggccagcttgttgagagcctttcgatgaccgatctttccagcctgcccgccaaccgcgacaccgatgccgcggaccgctcctatatcggccttgcgcggcagattcacgcgatggtggccgccggcgcgttcgaagccggcgcgcggctgccgtcggagcgcagcctggccgaccagttcggcgtgagccgcacgcaggtgcgcgaggcgatcatcgcgctcgaagtgcaggggatcgtcgaggtgcggatcggttcgggcatctacgtgtcggcggccgatgccgcgcggccggtgacgttcgaggtgccgcgcggcccggggccgatcgagacgctgcgcgcgcgggctgatcgaggcggaggttgccgcgctcgcggcgaccgagcgcaaggatgccgatctcgatcgcctgtttttctcgctgacgacgatgcgcgagcagatggacgacaaggctgcatacgacgcggccgatcgccagttccacctgcggatcgcggaatcgaccggcaacacggtgctgctgcacatggtcaccgcgatgtgggactgcgcgcgcagcgatccgctgtgggacaagatcgaggagcactttcactcgaccgcgctgcgcgaggcgtcgcaggaggatcaccagcggatcttcgcggcgatcatggcgcgcgatgcgggaggggcccgcgacgcgatgcgcgcgcacctgtcgcgcgtgatcgcggagttcacgcaagcgtggcgctagcgcgccggcagcaggcgagcggtgcgacaggcccgctgccgcgggccgcgtttcaggccgccgctaccaccatcaaagcccttcgaacaacgcgacatgctcgtcatacgcgcgctgctgccgtgcgtacgcatcgtcgagatgctcgtgcagtgcgcgctcggccgcatcggcgtcgtgccgctcgagcgcgtcgagcactttctgatgctgcgcaagcgtgacctcgccgacgatcggatcgcgcacggtcacgtgccgcacacggtcgatcggcgcgcgcacgatctcgacgagctgctgcacgcgcggtagccgggcggccgcgctgacggttgcatgaaacgcgttgtcgcacgcgatcgccgcgaccgcgttgccgcgttcgatcgcgcgccggtgcgcatcctggatgtcgtggagctgttcgagctcgcgcgcgctgatgacttcggccgcgcggcggatcgcggccgtttccagcaccttgcggatcagcgcgctcgacgaactgctcgcgcttcacgggcgcgacgaaggtgcccgattgcgcggcgatcagcacgagctcctcgcgtgcaagctgcagcagcgcctcgcgcacgggcgtgcgcgacacgccgagcgcctccgcgatcgcgcgctcgtagatcacgtcgttcggaagcagcgtcatcgtcacgatcgcgtcgcgcaacagcgcgtgaatctgcacggacagggcctgcgagcggtccagcgtgaattcggctgggatcaggcgggcgatgaaggtgtcctgggtggtgcgttctgacttcatgaatgggctagagggtggcaggcgaccggcgtcctcggtgggtgccggtcgatcagtatattagtgcgcataccgatttcggcggatcggtggcggattctcgatcgatcgattccgggtttaccccgtatcggcaccggaaggtatctctataatcgccaactaatatattagttggccaacgcttcgaagaaagcgtgaccggcgacccattcccactggagacacgtatgcacctcgaagactcagccggaccccgcccgacggcccatgcctcgaccgccgcgccgacggccgtgcgctggcggattttctggctgctgttgttgctgtcgtcgatcaactacatcgaccgcgcgtcgctgtccgtcgcgctgccgatcatctcgaccgaattcagcctgtcgcccgcgatggaaggcgtgctgctcagcgcgttcttctggacgtacgcgctgatgcagatcccgagcgggctgctggtcgaccgcttcaaggcgcgcaccatcgtcggcctcgcgacgatcggctggggcgcatgtcaggccgtcgcggccgcgtgcttcagttgggtgccgctgctgctgacgcggctcggactcggcatcgccgaatcgccgatcatgccggccggcgcgaagctcgcgggtacgtggctcacgccggccgagcgcggccgcggcgccgcgctgctcgacggcggcgcgccgctcggctcggcgtgcggtgcgatcatcatcaccgcgctgatcgcgggcctcggctcgtggcggctcgcgttcgtcgtcgcgggcgcgggcacgatcgtcgtcggcatcttcgcgtggtggtacatccgcaaccatccgtccgagcatgccggcgtgaacgcggccgagctcgagcacgtgaccgcgcatgcggccgcggcccgcgcgggcgagccgaagggcagcgtgccgtttcgcgaactgctgcgcgaccgttccgtgctgttcatgttcgcgagctgggcctgctacaacagcgtgttctacgggctgatgacgtggatgcccagctacctgcacaaggcgcacggcttcgacctcaagcagatgggcggcgcgaccttcatcatcttcatgtgcggcttcgtcggcgagctgttcggcggctggctcgccgacaagtggcgtgcggccggcggcgcgccgaaccgcgtgatgcgcgcgatgttctcggtcgcgggcctcgcgtccgccgcggcgatcctcgcggtgagcttcgcgacggggctcgtcagcgtcgtcgtgctgctgtcggtcgcgttgttcttcatccgctggtgcgggatgttctggggcgtgccggcggcgctcggcggccagtcccgggcgggcctgctcgcgggcgcgatgaacttcggcggcaacatcgtcggcgtcatcgtgccgatcctgatcggcctcatcgtgcagttcaccggcacctatttccttgcgctgatgttcttcgtcgtcgcggcattcggcctggccgtctgcgcgagcctcatcgattaccgcgaccggggcctcgactgaagcccgtcgcccgattcaaccggaaccgaaccatgtcgtcacttcccaccgaaacccggcagccgccggccgcgtcgcgcacgcgcgcgatccggctcgatcccgccgacgatgtcgtcatcgccgtcgagcagctcgtcagcggcacgcgcctcgacgacgaaggcgtgagcgtcgcggggctgatcccgcccggtcacaagattgcgacgcgcgcgatcgacgccggcgcgcccgtgcgccgctacggccagatcatcggcttcgcgagtcagccgatccggcccggccagcacgtccacacgcacaacctcgacatgggcgagttcgcgcgcgattacgcgttcggcgaaggcacccgcgataccgcgttcgtgcccgaggcgcagcgcgcgacgttcgacggcatcgtgcgcgccgacggccgggtcgcgacgcgcaactacatcggcatcctgacgtcggtgaactgctcggcgacggtcgcgcgcgctgtcgccgatcatttccgccgcgacatccaccccgacgcgctcgccgcgtatccgaacgtcgacggcgtggtggcgctgacgcacggcgtcggctgcgcggtcgaccccgacggcgacgccctcgcgatcctgcagcgcacgctcggcggctatgcgtgccatccgaatttcgcggccgtgctggtgatcgggctcggttgcgaaaccaaccagattccgcgcctgctcgaaacccaggggctgacggagcacgcgcggctgcgcacgttcacgatccaggacagcggcggcacgcgcaagacgatcgagaagggcatcgcgctcgtcgagtcgatgctggccgccgcgaacgacgtgcggcgcgagcccgtcgatgcgagccacctgacggtcggcctgcaatgcggcggctccgacggctattcgggcatcaccgcgaaccccgtgctcggcgcggcggtcgacctgctggtgaagcacggcggcaccgcgatcctgtccgaaacgccggagatctacggcgccgagcatttgctcacgcgccgcgcggagtcgcgcgacgtcggcgagaagctggtcgcgcggatccgctggtgggaggactattgcgcgcgccatcacgcggcgatgaacaacaacccgtcggccggcaacaaggcgggcggtctcacgaccgtgctggagaaatcgctcggcggcatcgcgaaggccggcagcacgaatctcgtcgacgtctacgaatacgcgatgcccgttcgcgcgaaagggctcgtgttcatggatacgccaggctacgacccgatctccgcgaccgggcaggtcgcgggcggtgcgaacctgatctgcttcacgacggggcgcggctccgcatacggctgcgcgccgacgccgtcgctgaagctcgcgaccaacagcgcgctgtggcggcggcaggccgacgacatcgacctgaactgcggcgatgtgctcgacggcggcgcgcgcatcgacgcgctcggcgcgacgctgttccggatgatgctcgacgcggcgtccggccacgcgacgcgcagcgagctgcacggctacgggcagaacgaattcgtgccgtggcagatcggcgcgatcacctgatttgaatcctctgcggcaaggagtgccactgatgcaaccgaacatttcatccgcgcgctttcgtggcgtgtttcccgtcgtgccgacgatcttcaccgacgacggccgtctcgacctcgacggacaacgccgctgcgtcgacttcatgatcgatgcgggatcgaacggcctgtgcgtgctcgcgaatttctccgagcagttctcgctcgccgacgacgagcgcgatgcggtgatgcactgtgtgctcgagcacgtcgccggccgcgtgccggtgatcgtcaccacatcgcatttcggcacgaccgtgtgcgcgcagcgcagccgccgcgcgcaggacgcgggcgccgcgatggtgatggtgatgccgccgtatcacggtgcgacgtttcgcgcgggcgaggcggcgatcgtcgagttcttccgcagcgtctccgatgcgatcgacatcccgatcatgatccaggacgcgccggcgagcggcacgcacctgcctgccgcgctgctcgcgcggatggcgatcgagattccgaacgtgtcgtacttcaagatcgaggtgccgcaggcggccgcgaagctgcgcgagctgatcgcgctcggcggcgacgcgatcgtcgggccgtgggacggcgaggaggcgatcacgctgatggccgatctcgaagcaggcgcgacgggggccatgacgggcggcgcgtatccggacgggatccgccggatcgtcgacgcatgggcggccggccgtgcggacgaagccgagcgcgagtacgggcgctggctgccgctcatcaatcacgagaaccgccaaggcggcatcgcgaccgcgaaggtgctgatgaaggcgggcggcgtgatcgcgtcggacgccgtgcgtcatccgctgccgtcgatgcatcccgacacgcgcgcgagcctgctgcggatcgcccgctcgctcgatccgcttgtgctgcgctggggccgctgagcgctgcgcgcgacggcacggttcaacgatttcacgattcaacgatgttcaacgaggacgatttatgcagatttctggcgcttccctgatcggtcgacgcagcgcggccggcgccgcgggattccaggcgatcgacccggcgaccggcgcggtacttgcccccgtgttcggccgcgcatcggcgcaggacgtcgacgcagcctgcgtgctggccgcacaggcattcgacgcgtattcgcatacgtcgctgcacgcgcgcgcggcgtttctcgacacgatcgccgagaggctgctcgcgctcggggattcactggtcgagcgctgcgtcgcggaaagcggtctgccgcgcgcgcgcatcgaaggcgagcgcgcccgcaccgtcgcgcagcttcggatgttcgcgcaggtcgtgcgggcgggcgactttgtcggcgtgcgcatcgatcccgcgcagccggcgcgtcagccgctgccgcgcgtcgacctgcgcgtacagcacgtcgcgctgggccccgtcgccgtgttcggtgcgagcaatttcccgctggcattctcggtcgcgggcggcgacacggcgtcggcgctggcggccggctgcccggtgatcgtgaaggcgcatcccgcgcatccgggcacgtcggcgctcgtcggtcgcgcgattcagcaagccgtggaggcatgtgcgatgccggatggcacgttctcgctgctgttcgacgacggttacgaggtgggtgccgcgctcgtgcgcgatccacgcatccaggcggtgggctttacgggctcgcgcggcggcggcgtcgcgctgatggcgctcgcggctgcgcgaccgcagccgatacccgtctacgcggagatgagcagcgtgaatcccgtgctgctgtttgcgcatgcgctcgacgcgcgcgcggaggcgatcggccgcgcatttgcggcggcgctgacgctcggcgtcggtcagttctgcacgaatccgggcctgattctcggcgtcgacggccccgcgctgcggcgcttcgaggccgccgccgccgccacgctggccgatctgcccgcggctgcgatgcttacgcccggcattcaccgcgcgtacgacgaggcggtcgtgcgccttggtgcgcaggccggtgtcgaattgcttgcgcgcggcgcggcggccgatgacgggatccgtcatgcgggccgcgcggcgctgttcgcgacgcaggccgaccggttcgcgcatcagcccgggttgcacgacgaagtgttcggccccgcatcgctcgtcgtgcgctgcccggatctcgacacgatgcatgcgctcgtcgagcggctcgacgggcagctcacgacagcgctgcatgtcgacgacggcgatcacgacgcggcgcgtgcattcatgccgctgctcgaacggcgcgcggggcgcattctcgtgaacggcttcggcacgggtgtcgaggtcgcgcatgcgatggtgcacggcggtccgtatccggcgacgtcggacggccgctcgacatcggtgggcagcctcgcgatcggccgcttcctgcgcccggtctgctatcaggacgtgcccgatgcgctgctgcccgatgcgctgcgcgatgcgaatccgctgggcgtgccgcgcgccatcgacggacatcgcgatgcgcaagcgtgacgggccggttcccgaaccggtgaagcgacgacggcgcgctttcgactgatcattggccgctcgcccgacggcgtttcatgcgtgtgcggcgatgtgccggcgaagcggcgccgtcgtcgccgcgcacgcgctgcgtgcggcttctgccgattgcgcggcgatgcgttttatggtctcgttgcgggatatcgcatcgactcgaaaaaggacgtcgaatgcagccgggcgattcacacggggtccgattagtcagggaatcggcgcacgtacgcgcgcccgcggcgccgtgcgcaggctgctcatcatattgacactgggcttgctcgcgcccggcctgccggctttcgccgactctcccgaaaccgtcaacgacaacgtgctgcgcgtgctggcctggcccggttatgcggaccgcgacgtcgtcagcgcgttcgagtcgcaatttcacgtacgcgtcgaagtgacgttcgtcgactccgacgaagcgttgtggacgcggatgcacagcgcggcgccgccgccgtacgacgtgctggccgcaaacacggccgagatccagcgctacgcgcacgaacgtctgctcgcgccgatcgacctgtcgcgcatcccgaaccggcggcggcagttgccgaacttccagcagctcgcgacgatcgacgggctcgtcgaagaggggctgcccatgcgatcccgtttacgtattcgtcgatggggctgatctacgaccgcaggcaggtttccgccgcaccgcgctcgatgcgggagctgtggaatccgcgctaccgcggcaaggtgctcgacttcaacagcgcgcagcacaatttttcgttcacggcgctggcgctcggctatcccgatccgttccgcctgtcgcccgcgcagacgctcgccgttgcgcacaagctgatcgacctgcgccgcaacctgctgacgtactacacgcttcctgaagaggcgaccgcgctattcgtcgagcatcgcgcggcgctgatgttcggcaattacggcacgcagcaggtggaactgctgcggcgcgccggcgcggacgtcggctatgtgatcccggacgaaggcgcgctcgcgtggctcgactgctgggccgtcacgcgcggcgcgcagcatcccgagctcgcgttcgcatggatcaactacatgctggaaccggcgatcggcgcgctgctgaccgaacgccagggcctcgcgaacacgctcgcgccgccgccgggcctcgacaccgggcaccagcatctcgtctggctccagcccgtcgaggacatcgcgcggcgcgaatcgctgtggagccgcatcgtgtcgggcgaccgtccggagcggttcggaaaatgatccggctcgggctcacatcgaaactgtcggtgctgttcgcatgcatcggcgtgatcgcgtccggcacgaccggctattacgcatatcgcgcgaaccgcgcgatgctcgtgcaggaggcacagcacagcctgctgatgtcgacgcaactgctcgggcaacgcttcaccaccgcgctgtccgacgtcgcggacgatgcgctcgtgctcgcgcagatgccgtcgtgcgcgctggtctcgggcggcgacaaccgggatggcgcgtcacgcgcgcggctcgagctcgagcaggtgttctacagcttcatgagaaatcacccggaatacctgcaggttcgcctgatcgcgcgcggggatttcgggatcgaacgcattcgcgtcgatcgcgatgcgcatggcatcgtcgtgctgccggacagcgcgttccaggagaaaggacagttttcctacgtattcgatacgctcgcgacggcaccgggtcatatctacctgtcgccgatcgtgatcaaccacgagacgggaacgcacgcggccgaggggctgccgatcctgcgcgtgggcacgccggtcgtcgacgcgtcgggccagacggtcggcgcactcgtcgtcgatgtcgaactgtcgcgcgtgttcgaccggctcgagcgcgatctgccggaagactacgcggtgtatctcgcgaacgagtggggcgatttcctcgtgcaccccgatccgtcgcagacgttcggcttcgatcgcgggcggcgcgtgctgatgcaggaccgcttcgccgtcacgcgcgcgctgttcgacagcgcccgcacgaacgttaccctcaatggcctgaccgatcccgccgatgcgccggggcagatgttcgcgttcgcgcgtacgccgttcgggcacgacgagggcaaccgcttcgtcgtgctcgggatgggacgcccgctggccgacgtgctggcgccggccggcgtgctcggcgaacggatcatccggatggtgctcgtgtcgagcctgatggcggtcatcctcgcgatcctgttcgcgcgtgcgatcacgcggccgctgcagacgctcgcgcgcggcgacgcacgtgttcgacgatccggccgccgagcagttgccggtcgggcgcgccgacgagatcggcgtgctcgcgcgctgtttcgacagcatgcgcgtcgagatccgcacgcaggtcgcgatgctgcgcgcgaagcaactggagctcacgcacctcgccggccacgatgcgctgaccgcgctgccgaaccgcctgctgttcatggagcagctcgatgccgcgatccggcgtgcggccgcgatgcatgagggctggccgtgatgttcgtcgatctcgaccgcttcaagcagatcaacgaccagcacgggcactcggccggcgaccgcgcgctcgtcgcggtcgccaagcggttgagcctcgtgctgcgcggcggcgacatggtcgcgcggctcggcggcgacgagttcatcgtgctgattgcggacgtgcgctcaccggcggtgatcggcgacgtcgcgtcgcgcatccagctcgtgatggctgaagaactggagttcggcgaccggcgcatggccgtcggcgcgagcatcggcgtcagcgagtttccggccgacggcgcgtccgccgaggaactgctcgtcaaggccgacgcggcgatgtacgcggcgaaggcgtctgcgcaatgcgcatacgtgcgctaccaggaactggtcggcagcgggagtgccgccggcggcggcgcggacgaagcggccggccgcgtcgcgtcgggcgaaagccggtgacggccggctgcacgatacgtgcgatgcaaacgcaacgagcccgtcgcgggacgggctcgttgatggtgcaggctgcgcgcgaaggcgcgcggcggcaggcttagtggccgaagtagaccgagtcgcgcgggttctgcaccttgacgaccggtgcgccaccctggacggtcgcggccggttgcgcaccgtagccgctgttgtcggcgccgcgcacgcgggcttgcgcggcttcgatgtcggccgggtagtgcgggctcgcctggctcggcttgtagccggcttgttcgagctgaaccagttcgttcttcacttgcgcgcgggtcacggtgctttgggcgaatgcgccgaacgaagcggacagggcaacagcggcaacgactgcggaaacgagcgatttcatgatgacctccgatgtttattggctttccgcgttcgacaccatgtcgtaagcggttgattacatcgtaggcgccggtcgacctagggtaaacgtgagttttggtgaaagatcgttgtcgctggagtaataattccgggatatgcgcgttccgtccctattcgatgttgccggatttgcaagggagcggagcgaatgcgcgcgacgcggatggtgtgcacggacgggtgcccgacggcgaatgcgcgggtggagaggcggccgacgggtggcgttgccgacgggtcagacgtcgtcgtcgatttccttgcgttcccggcgttcctcgttgccgcggcgcgcgcgcaggcgctggcgcgacagcacggcgatcacctgctgggtcggcgcgccggacggcagttcgttgcggatgcgatcgggcaccatgggcaggcccgcgcgttgccggcgcagcgccttggcgattgcccggcggcattcgtcaccgtggcaatcccattcatcgcggattctctggcaataacggcattgttccatccggacagtctaacgcgtcttcgggaacggggctggacgcaccggcctgagtggatcaggcgccgggtgcggcatcggcgagcgcgtttgcatgcgactggaagcggcgatgttcttccggtggcacgagcgagccgcccgtcgcccagatgacgtgcgtcgcccggcgcaggtcgatcgcgtggcgatgcacgtagtcctttccggccgggagtgcgtcagccagccggggccgccgacggcagcggcggccgacggctcgagttccacgcccgtcgcgcgccggaccgcgagcaactgcgcgtaaagctgcgcgtcgctgacggtgacgacgcccgacagcagggacgccatcagcgggctgacgaggtgcgacgcctgcgcgactgccaggccatcggcctcggtccggttgtcgagccccgcgtcgtagacggatacgggcttccgggccggcggccagctggaccagcatgcacggcgaagcgacgggttccgcgaaaaagcaatgcacgtgctcgccgaacagcgccttgagaccataggcgatgccgcccggcgcgccgccgacgccgcacgggatatggacgaagagcggatgcgccgcatccacgctgcggcccgccccggcgagctgcgcggcgagatgccgggcaccggccgcgtagccgaggaacagcatcagcgagccttcgtcgtcgacgaagtggctgcgcggctgatggcgtgcctgcgcgcgtcccgccgcgacggcttgcgcgtagtcgccgtcatgttcgatcacgcgaacgccgcgtgctctcaggcgcgccttcttccacggcttcgcgtcggtcgacatgtgaacgaccgactcgaaccccagcgcggcggccatcacgccgatgctcaggccgagattgccggtgctgcccacgatgacggtatgcgcggcaaacagttcgcgtgcggcggtcgaggcgaggagccgacggtcgcccgcgggttcgagcaggccgtgttcgatcgcgatcgactccgcgagcgcgagcacttcatgaaagccgccgcgcgccttgatcgagccggcgaccggcagtgcgtcgtcgcgcttgatgaaccacgcgccgtgttcgtccgccgggagcgacaagctgcgctgcaggctgtctgccggcatcagcggcgattcgattttcctgcgctcgccgcgagttcgggaaacagctcggccatcagcggttcgcagcgcgccagccgcgcttcggccattgcaatggcgtcgatcgtcggtgcgtcgtgcggcagcgggctgccggcgtggggattcagccacagcagcgggtggcgcgattgcagcttggctaatagatcggaaggctggagcgtgaaggtcatggatcggtcttgcgtcggatgaacggcgaatcaggcttgaatgctacgattcgaaccggttgcgcgaaagcgccgatttctaatgaatgcattagcccgacttataacgatgcgactcgatggttcgatccttggtgcgttgctgtgctttgaaacggccggccggttgctgagcttcacgaagacggcacaggcgttcaacctgacgcaaagcgccgtgagccagcagatccggaacttggaggaccggctgggttacccgctgttcgtgcgtcaggcgcgcgggctgaagttgaccgagaagggcgcgaccctgctcggaacgatgtcgagcgcgttcggcgacatccatcgcacgcttcaggcgctcggcatgccggacgcgccgctgcaggtgagctgtctgccgtcgttcgcgctgcaatggctgatgccgcgcctgtccgaatttcatcggctgcaaccggacgtgccggttcgcgtgaaggccgagtttcaggtgctggatcgtcaggccatggagaccgacgacatcgacgtggcggtgcgctacgaccctgtgcaatacgggcggctgcatgccgaggccatcctcgacgaaatcctgtttccggtcgccacgcccgcgtatctggcgcagcatccgtcctttgccggcggggagttgctggacggcgtcgtcctgctgcacgacgcggctccgtggggcggcgcacccgagttcgtggagtggcgcacgtggctggacgcggtgcgtcccgcgtggacggcgcatcttgacggcccgcagttcaatttctccagcctggcaatcacggccgcgctgaaccatcagggcgtcgcgatggggcgcgccgcgctggtacacgacgagatcgcgagcggacggctcgtggatgttttcggcaggcacgtgcgtgcgccggcgcgctacatgctgttgtcacgcaatccagacgatccgcgcaccacggtttttcggactggctcaaggccgagtgcgcacgcttcgatgcggctcggtcacgcctgctttcgaacggaagccggcacggatagccgaggctgccggatggctgggtcggagtgcgaaggagttgcgaaatgagcgccgcacactacgatttcccgtccgtctccatacggaatgcttgcgcacggacgcggatggcgagcgttacttgagttgccagataccccagatggcgatcaacaggccaaggccgaatccgcagccgagcaacacgtaggtttccattgcaggtctctgaaagcgtggcagcgccgatgcggacatcggcgtgcgagcaggacagtcggtgacgtatcgttcgcatcgtcgggcgcggcgatacgccgggtccgcgaatactacgctcggcagctttcagaacgcatgcgggatcgatggcaatccgccgcccgtcagtgcgtgcccgcgtgcgtgttgtccatctgggtaacgtgcgattcgccgtgccggaacacgcccgatttccagatcatctgcgatgctgcgacgagcacgaagagcagcacgaccatcctgaagctgcggggcgacatcttgtcccgcagcgggcgaacgagccacatgccggcaatggccggcaggctggccgccgccgagatcgcgaggtcggcggcgctcgcgtgcgcggcgccgctgaacgtcgtgagcagcgtgacgatcgacaccacgaggatgatcgcgatctgcttcgtgaaggcgcgcccggtcgcgccggacgaaatcaggtaggtggcgagcagcgggccgggaaccgacgcgatgctttccatcagcgcggcgccgaagccgagtgcgaagccgacgggcttctgccacgcaggaggcaggttgagcttcggcgcggcgagcatcagcgtcgcggcgacgatcagcagcgcgccggacgccgcctgcgcatgacccggattgagcgagagcaggatcgcgacaccgacgatgttgccgatcacggtgcccgcgatcggtgcggcgatcttgcgtgcggtcgccagcacctggccgccttccagcgcctgcggaatgttgccgaggatgatcggcatcgacagcagcagcaccgcatgccggatcggcaggaactggctgagtatcggcatcgcgatcagcggcacgcctatgccggtgatccccttggccatgccgcccagcagcagcgcgacggcgatgccggccagatcgaacgcgccgagcccctgcaggctggaaaccagcacaccttcagtcagattgaaatgcatcatggaatggcttgtcgcggcatatccggcagcgagcgctgtcgaaggagcccgctgcggcgcgtgcgtgttgcacgcatgtgttctggatcggcttggccgggcgtcgatcacacggcgccgcatcgttgcgcggccgggtccgcaggcaatcgacgcgcggttcgaggatgcatcttacccgagcgttgcggagggcattcggcgcggggcgcggcgtgccatcggtatcgtcggcgcgatcatgtacgcggttcaatataattcatgaccatgcatcgcctcatgtgcgatatgcatctactggaacaaggagacccgatgacccttgcgcagttgcaggccctggcggccgtggtcgaactcggctcgctcacggccgcggccgaccggttgagccgcagtcaatccgcgatcagtcatgcgctgaccgagctggaagacgtcacggaggtcaagctgctctggcgcgaccgtcagccggtcgtcctgacgccggcgggcgaacgcctgtggccgcacatccagaacgtggtgcgcgaagcgcagttgctgcgccagcagttcagcctgtcgcgcggcaagctcgaagggaagctggtggtcgcgtcgctgccaagcgtgtcgctggcattcgtcgtgccggcactcgaggcgctgaaggagatgcaccagggcgtgtcggcggtgctgctcgaaggcacggacagcgaagtcgaagggtggatcgaggacggtaccgccgacgtcggcgtggtggccggcacgaagaccttcgcgcacacgctgccgctgctcgacgaggacttcgtcgcggtggcggcggatggcatgttcacgggccgcaagagcgtgtcggcgaagcagttgtccgcggccccgttcatttttcgaaggcagggtgcgggccggtgatcgcggattacttcgcgcgcagcggcacgccgctgcacgctgcgttcaacgtggtcgagatgcgcaccatcctgtcgatggcggaggccggcatgggcgtgtcgatcgttccgcgcatcacgctcacgtacacgccgttcggtggccgcgtgctggcgctttcgccacggctgcatcgttccgtccggctgtcgtggaacacgtccggcaatgcgatcgccgatgcgttcgtgcggctcgtcgacgcgcaacgcgcgaaggcggcgaaggcgattcacgcgcgcgcgaaaaggagccggtaacgaacggccggtgcgatgaaaagcgctcatgggcggcttgcagtttattcatgccgatggtgatcgagatgcaatacattgagcgaactcgccctgaccgcttcgccccgaaggagattgccgtgccggccttgcccaccttgcttgcattcggactcgtgtcgctcggcatggtgctgacacccgggccgaacatgatctacctggtgtcgcgctcgatctgccagggccgccgtgccgggctggtgtcgctcggcggcgtcgcgctggggttcgtcttctacatggtgtgcgcggcgctgggcatcaccgcgctggtattggccgtgccgtatgcgtacgacgtgctgcgctttgccggtgcgctttatctggcgtacctggcgtggcaggcgctgaagccgggcggccgctcggcgttccaggtcaggcaactgccgcacgatagccgcgccaggctcttcacgatgggcttcgtcacgaacctcgcgaatccgaagatcgcggtgatgtatctgtcgctgctgccgcagttcatttcgccggggcacggcagcgtgctcgcgcaatcactggcgctcggcagcgtgcagatcgcggtgagcgtcagcgtgaatgcgctgattgcctgcatggccggcgccatcgcgggttttctggcggggcggccggtctgggcgtcggttcagcgctggttgatgggcatggtgctggcgggactcgccgtgcgtatcgcactggagtcgcgcagttgacgcgagtgagtggccgacgggttgcgggatcgcagggggcttccgagttgcatcgtgatgaacgcgcccggtttcgtcagccctgtctgttgccctgcgcttcgttgccgacccgcacgggcgcggcttttgcgttgcgccggccgcgcgtcgcgagccagcacaggatcgacccgccgcataccatcgacgcgccttgccagaattcgatcgacagcggcgcatgcagcagcgtcgcggcgagcatggcggcgagtaccggggtgaaatacgatgcgccgacgatgatcgtcacgttgccgtgcatgatgccggtgttccaggccgcatagccgaaccccagcgccgacgccgccagcacgatgtagatggccgcttgcaggctgaacgtcatgcccccgccgccttcgaacgcgaacttgatccagagcgccagcgcaaccagcatgaagaacggcgtgacgccgttcttgccgtccgcgatgcgcgccgtcaccgtgcaatagccggcccagatcagcgcaccgaagaacgcgaggccgtagctcagcggattgtccgtgacgttgcgcagcatgccggccggatcgagccctggtcgccgccgaggacccggcagatcccgagcatcgacagcaggacgccgggcacgaccagcaggttggcgcgctgcttgttgaacacgattgccgcgaccagcgtgaagctcggccacagatagttgaccatcgcgacttcgatcgcctgccggccgttgctggcatagccgatcgacagcgacaggcacacctcgtacgagacgaacagcagcccgccccagagcagatagtttttcgggaaccggctcaggtcggggaaaccgaccgagaacagcagaagcacggacgccaccgtatagatcatcgcggcgccaccggtcgcgccgaggctttcgctgactccacgaacgagggcgaccacggaggcccacaacaacaccgcgccgagcccggcgagcgttgccttattcttgcgcttcatgcgtcctgcctgtttcaacattcaaattcgctatcggatgattcggttccgcctgcgcgggacccacgggtacgtcgatccggatggtctcgatcccggtgtgccggccgcgcaccgggatcgacatgccacggccgccgaccccggatgcctcgtcgccgtcgaacggcgtcgtcccgtcgtcttcgccgaagcagttgacggtcgcgaacgtcccgctcatggcggagtacgaggcgcgcagtctaccgcgtgtcgtcgcgcaatggcttgtgaggggcgtacaacaagtctccgtgcgccatcgcggtatagtcgcgcggcagattcgcatcgagcagttggtcaggttttcgttgtggccagtcgcccgtatcgcgctttcagggagggaagccatgaaagaagtgccgtatttctcgcagtgggaatcgacgcacctggtttcgcggttcgtgtcccgcgaattgcacgcggaggacgacccgttgtggcatcgctccggcgcaagcacgccggaggaatacgcgcagtggagcccgaacatctgcggtatcgcgtgcctgaagatgctgctcgcataccgctcgaacacgatcgtgccgctgctcgaactggtacgcgaggccgtcgggttcggtgtctaccggcccgaactcggcgacacgggcaagcgtctgcattaccggcccttcgtgcactgggtgcgcgagcgctacgggatcgacggcgatgtggtggaaggagtcgattcggccgcgctcgaaccgaagctgcatgacgggcacatgctgatggcgtcggtgcatcccggcatccggcacgacggcttcgagccgccgtcgcggggcgggcacctggtgctcgtgttcgacgcgaaccgcgacaccggtgactggctgttccacaacccgtccgggttcgacgtgcgcacgcagcgcaacgtggcgatgccgcgcgccacgttcgaccgctatttcgcgaaccgcggcatcctgattgccccatgacgttgcgcatgcaacgaatcccgcgcgcacggcgtcaggcgcccgtcgcaacgggcgcctgaccgatcaccggccgttgcgcttcttgctcagctcgatcgtctcgaacagcgtgtagtcggcggtcgggtgctggtcggcgcccggtgcgtggtagtagcgcatcgtgatcgtcgtatgcccgtccggcttgcccgggtcgtggtcgaacacggcaatcccgtagccggtgccggtatcgcgacgcgcggaccagatcgcatcctcgagcgcatcggccggctggcgcacgaacgtattcggcgccgtgcccggcaccggccggttgggcttcgtgaacaccttcgcccgcgcaaagccggtcgccgggttctcgccgatacgtccagcggcgcgctggtgccgccgccgcccaggatcaggtggatcgtgccgtggctcgtgtcgaacgtcgtgcggtccgggtcgttcgatccgaccgggcgcggctgcagcgtctcgaccacttcgccggtcgtcgcatcgacgcccgcgcggtgattgcagccgcgtaccgggtagctgcgctcgtagtcgtgatcgtggccgcacagcacgaggtcgacgccgtaacggtcgaacagcggcagccacgcttcgcgaatgcccttgtcggaaccgttgcccgtcttcgacgaactgagcgcgtcctggtgcatctgcacgacgatccagtcgatgtcgtcgtcgtgcgcggcatgacgcagcgtgtgttcgagccagcgcgtctgctcgccgttgctgtagccgcgcacgtagaacgacgtgccgggctcgatcggcgggcggcccgtgctcgcggccggcacgagcggcgcggggccgccgacgaacgcggcggcatcctggtacacgacgtcgtcggcgtcgagcgacacgaacagcaccgagctcacgcggaagctgtaccagcggcccgggaagcgcgtgccgttctccggcagcgtatagcgcgcgagatacgagtcgagcccctgcggaccattgttgaactcgatctcatggttgccggggcagggcatccacggacgattcgcggccgacgtctggttgttgttgccgaaatcgcgccacacctcgggctggtgcgcggggttcaggttcgcgtagcagaggtcgccgttcagcaggtggaacagcggctggaactgctcgacggcctgcaccgcgaagcggctctgcggcgacgacagcacccaggcaccgttcggcgtcgcaaggtcgccgtagctcgtgaagcggaacggcgcgcggccgcgcggcgcggtcgagaaatgcgcggagaacggctgcgcggcattgctgtcgttgtcggccgtgatctcgtagcggtaacgcgtattcggcttcagcccgtgcacgcgcgcgtggtacgcgaacacggtctcgccgttcaggccgtcggtgtacaggcgctggacgccatgcacggtgcgcggcggctcgccgtcggcgacgatgcgcgcgcgcggattgacggccgacgcgagcgatgcccacgagatcacgacttccgacgtcgggtcgttgccccacgtcaggtggacctgttcgggcgtgccgtccggggtcgacgcggcggcccgggctgccgcgaggccaccggcggcggtggcgaggccggatacgccggcgagtttcaggaagccgcggcgcgagacggatgcggcgggctcgttcggctggatcggggagttgtcctggttcgacatggtcggtgttttcgtggatggagacgcgagatgcggaaccgcccggccgtgcgtaagcgtggccggggcgtgggccggaaacgagcgggatcccggtgccggacattgtcggagcgcagttttgccgggttgtgacagcacggcaacccgcgggagcgccggcgcctgccgagcttgcggatcggggcatccggcccgcgccggcgcgcgtccgcttcggccgatatttatttgccgacatcgcgacggattctgaccacctgcaccgtttaacgcatgaacggccgcttccggtcgatacctgctacgtcggagtctttcatgaagctttccatcccgttgcggtttgccacggcatgcgtggccgcgctggctgcgtccgctgcgttcgcgcaggccgtcatcgtcgcgccttacgcgccgccgccgcctcgcgtcgaagtgatgccggcgccgcgcgcgggctacgtgtgggaccagggccactggcactggcgccagggtcgttatgtctggattccaggccactggcaagtggttcgcgtcggttatcactgggtgccgggccactgggccgcgcgcggtccggcgtggcgctgggttccgggtcactgggcctgatgcgcaagccgccgcacggcacgtggtgccggcgcggcggcgccttcccgcaacgtcatgagtcgcagccatgccctttcgaaccgtggtgatactggcagccgcagccatcgtgctggccggctgcgtcgtggtgccggcgcgtccggcctattaccggcccgcgccggtcgtcgtatattgagcgcgccggccgccgctcgcgcgaccgggcggccggcatccgatcgaaccgatcgacacgatcgccatgcggcctgaaaccgatgccgatgaaacggaccttgccgatgccgtgcgcgatgcgtgcggcgatcccgaaccgccggtgtggcggggccgggtaatggcgcggcgcatgcaaggagagcacgacgatgagcttcggtctgccgacaggcgcattcacgagcgcgccgcggctggacgcgcgacgcgctggagcgccccgcgttgagcgacggcgatccggacgccgcgctggtggcacgggtcggcgcgcgcgacgcgtcggccgtgcgcgtgctcgtcgcgcgcaagctgccgcggctgctcgcactcgcgacgcgcatgctcggcgaccgcacggaagccgaggacgtcgcacaggagacgttcttgcggatctggaaacaggcgccgggctggcgcgagggcgaggcacggttcgacacgtggctgcatcgcgtcgtgctgaacctgtgctacgaccgcttgcgcggccgccgcgaggaaccggtcgacgtgttgcccgacgtgcccgatccgcaaccggagccggccacccgcgcggagacccgctcgcgcgacgcgcgcgtgcggcaggcgctcgcggcgttgccggcgcggcagcgcgaagcgctcgtgctccagtactatcaggacatgtcgaacatggaggcggccgacctgatgggcattaccgtcgacgcgctggaaagcctgctcgcgcgcgcggcgaaacttgcgcgcgcaactggccggcgattcacctagcgaggacatccgatgacacccgaacgatttcgtaccatcgtcgccgcgtacggctcggatgcgcggcgctggccggacggcgagcgcgcggcggcggaggcatgggcgcgcgcgcatccgggcgacgcgttggcggcgctggacgaggccgccgaactcgacgcgtggctcgccagcgatacggtcgcaccgcccgcgccggcgctcgtcgagcgcatcgtcgcgacggcgcccgccccgcggcgcacgcggcggcggggcaccgtgtggtggtcgggcgcggcattcgcgggcgtgggcctggccggcgcgctcgcgggcgcggtggccgtgtcgatgctgatgctcgggagcgtgccgcctgcgcacgagcagggctatctgacaacgacgttcggcggaccgagcgtggactggagtgatgaatgagtgagcgtggctggaaattcgtcctcgtcggttcggtcgtgctgaacgtattcatgctcggcgcgatcggcggcggcgcgtatcagtggttctcgacgcatcgcgacctgcgggccgcgggcgcgcctgcgtcgcgcaccgcattgcgtttcgccgcggacgagttgccggacacacgccggcaggaattcgccgccgcgctgaaggcggcacgcaaggacggtcgcgacttcgcgcgggaagggcgcgacgaccggatcaccgtgctggatctgctcgccgcgccgcaactcgatcgcacggcgatcgacgccgcgctcgaccgcacgcgtgcggccgattccgcgctgcgtgcgcaggtggagcgcagcgtcgtcgatttcgcggcgacgctgacgccggacgagcgcgcgaagttcgtcgacgggttgcggcgtagcggcaactggcggttgccgccgaggttgcagaagaagcagggcgaggcggggagtcagtaaggaaacgcggcgcggaagacgcgcggcggcgcgcctttcctgcgctgtgcaacgcgtacgcggaacgccggtcggcaatgctttcaggcacgctttcgcgaacgatcgcaacgcgaccacggccacgtgacgctgcggggacgttcaacgtgccagcatccaggcggagatcgcgtcgaccacgctgctctccaggccgttgaagccgtgataggcgaacgcttcgcacggatcgccccggacgtgccgcccgacacgatcatccgttcggccttcggcgatgcatccaggttcttcaacagcgtatccgtttcggacacggggcaatgcttgcagccgtcgttctggtgatgaacgacgagcaccggaatcctgaggctggccaggttcatgtcggtgaccgcggtaccgcctcgatcttcacggaggatcgtggacgtcagcacgataccgtccggcccgccgccgccggccagcgcaatcgcaacggcagcggcggactgggtgccgcggctcgtcccgaccagccagaccggcacgtgcagttgctccctcaaccacgcgatcacggcacgcgcgtcgtcggcgtgttccttcgagagtcgaaagccgttgaggtagggcgcggattgccggtcgctcggtgcatcgatgaccgcgacagcgataccgtcattcacgaacagttgcctggtgcgcacgagaaagttgcctgcgccccatccgaaccggccggatgggtccagttgcagcccgccgtgtccgccggcgtaaaggatggccgcggctttcggcgcatccggcgcgatgaagagaaaccgctgggtgactccgggacgggtcgggacgtcgacgaccctcggctgaccctgcgcgtgagcgggataaccgtgcagcgccaaagccatggcgagcagccacgcgcgtgcccggcgcatggccggacgcttcgcaccgaagcaacgaaaccgcgcgtgcaagctgacgggaagtgggttcatcgtagcggtggccggcgcattccgccgtggccggcggagtgcggcagcttctcctgttcaatgtagcggcgccacgtcgacgcgagtgtgccgggccgtggctgcccgaaccgtcgtgttccaccggacgcgcggcgttcaaggcgattcggccgactgaacgatttcgccgatgtagcgcctgaggtcgcgcgcgtcgtccttcatgcgaatcgattggcaaaggcgacaacgggagccggcagcaggatggcgagcagcgtggtcacggccgatctccggttgcgtcgaattcttgctccggggcggggcgacgatacctccgtgacccggagcgatacattccattgagtctaggctggtttccgggaacggcaagcgccgggcggatatcggcgacaaggcggcattcgacccgtccagggtttcggccgacgcatcatccggccgggttcatgccggtcagcgggcgaaagcctgtcggccgaatgtcgaagcgtgcccgtccctcggcggggcacggggccgcgttgcggcggctgagcgatccgtcgatgcgcggccaccgtcggtcgaatccgtgctggaaactcgaacggcgacacacacgttttcaagtccgcgcgacaaacccgaaatattcgcctacccggcgacggatttcccgccggccgacgtttaacacgggtacgcatcgcaagagccccgccatggaccacccgaacgacatcaccccggccgccatcgcgctgaaccgcttcggtctcggcgcgcgggccgacgaagcgccgcctgccgacccgaaggcggcgctcgtcgcgcaattcgaccgttacgaagcgcggccggccgcgtgggccggcgagcccgacgcggtggcgctcgccacgcgcttcgcgaacgcgcgcaatgcgatgaccggcgacgatcccgcaacgaagcgcgcgaccgagcagtcgatccggcgcgacggcaacgacacgtaccgcagcgccgtcgtcgcgcgggtcaacagcgcgttgaacacgcccgcgccgttcgtcgagcgtctcgtgcatttctgggcgaatcatttcgcggtgtcggtcgacaaggggccggtggcggcctacgcgggtgcgttcgaacgcgacgcgatccgcccgcacgtgctcggccgtttcgaggacatgctggtcgccgtcgagcagcatccggcgatgcagctgtttctcgaccaggcgcgctcggtcggccccgacagcccggccgcgctgcgtgccgaagcgcgcaatccgtcgggcaggcgcgggctcaacgagaatctcgcgcgcgaaatcatggagctgcacacgcttggcgtacgcaccggttatacgcaagccgacgtgacggaattcgcgcgcgcgctgaccggctggagcatcgccggcgggcgcggcccgcagcccggcgatgcggcgcccggcgcgttcgtgtttcgcccgaaactgcacgagcccggcgtgcggaccgtgatggggcgcagctacgaccagcccggcgaatcgcaggcccgcgcgatcctgcacgacctcgcgcattcggaggcgaccggtcggcatatcgcgttccagctcgcccgtcatttcgtcgccgacaatccgccgcccgcgctgaccgaccggctggcccgcgcattcgacgcgagcggcggcgatttgccgaccgtctatcgcgcgctcgtcgacgcgcccgatgcgtggtcgccggtcaaccgcaagttcaagacgccgtgggagtgggccgtttcttcgctgcgcgggctcggctggcacgacacgggcgacctgaaggccgcgccgctgctcgcgcagctcggccagccggtgtggcggccgggctcgccggccggctacgacgacgtggccgcgagctgggccgcgcccgatgcgctcgtgcgccgcgtcgagctggcgcagcggctggccgcgcgcacgggcgaccggctcgatccgcgcacgctcggcaatacgctgctcgcgggttcgttgagcgcaccgacggcgaccgcgttgtcgcgtgccgaaagcgcgaccacgtcgctcgccttgctgctcgtatcgcccgatttccaacggagatgaccatggcactgtcccgccgacaattcctgcgcgtggcggccgccggcgccggcgcgatgctcgtcgcgccgcggatcgtattcgcgaacgtcgagaccgaccggcgcttcgtgttcgtgatccagcgcggcgcggccgacggcctgaacacgctggtgccgtatgccgaacccgcgtatgcgtcgctgcgcggcccgctggcgatcgacacggcggccgcgacgcggctcgacggcacgttcgcgttgcatccgtcgctcgtgcagaccgcgcagttgtaccgcgacgggcaggcgctgttcgttcatgcgatcgcgtcgccgtatcgcgaccgctcgcatttcgacggccagaacgtgctcgagacgggcggccgcgcgccgtaccaggtgaaggacgggtggctgaaccggctcgccgcgctgctgccggcgacgcgcgaaagcgcgatcgcgttcgcaccgaccgtgccgctcgcgctgcgcggcaccgtgcaggcggcgtcgtacgcgccgtccggtttgccggccgcgccggacgacctgctcgcgcgcgtgtcggcgctctacgaggccgacgcgcagctcggcccgttgtggcaatcggcgatggatgcgcgcggcctcgccggcgatgcgcatgcgcggcaggatccggcgggtgtcggcaagctcgccgcgacgtttctcgcgcgcgacgacggcccgcgcatcgcgatgatcgaaacgggcggctgggacacgcacagtgcgcagaacgcgcggctcgcgaatcaactgaaagcgctcgacacgatgctcgccgcgctgcgcgacggcctcgggcccgcatggcagcagaccacggtgctggtggcgaccgagttcggccgcacggccgccgcgaacggcacgggcggcaccgatcacgggcaggcgtcggtcgcaatgctcgcgggcggcgcggtcgcgggcggccgcgtgatcgccgactggccggggttgcggccgggcgacctgtacgaagggcgcgacctgaagccgaccgcgtcgctcgacgcgctgatctcgggcgccgccgccgaaagcctgcggctcgatccgcaccgcaccgcgtccgcgctgttcgccgaaagcggcgcgatgcggccgatgagcgggctgattcgcggcacggcgtgatgcgcgccgattcattcacgacacaaagggagaatgcaagatgatgaagatccgctccgtttcgctcaccgtgctggtagcggccagtgcgacgctgatgtccgcctgcgtggtcgagcccgtgcggccgccgcagccggcaccggtcgtcgagacgccgccgccgatgcccgcgccgggctatcgctgggcgaaggggcattaccggtgggccggcaatcactgggcgtgggtgcccgggcactgggtgggcgtgtactgatcgggcgtgacgtgccgcgcggcgtgcggcgagggtgtgggaagcggcatcgtgtattgaactgcgatgcacgttgccctaagctgccggatcgcggcgacgggcatccggcgacgggcttccggcgacgggcatccggcgacgggcattcccgttcgtccgccacggcgagccgatccgcggccgccgatttcttcgttacggcacccacatgaaagcatggctcgttgcgctggccgtcgtcgccggcatgaccggcgcgcacgccgcgtcgttcaactgcacgaaggcgtccacgttcgtggagcgtgaaatctgcgccaatccgacgttgtcgcgtctcgacgatgcgctcaacgcggatttccagcacatgctctacgacttcagcaactatccggtcgaggatccgcccgagtacgagcagttcatggcgacgcagagggcgtggctgaagacgcgtaaccgctgcacgacgacgcagtgcctgatcgacagctaccgcaagcgcatcgacgtgctgtgcggccagatcgacgtgccggcgaaaagcgaccgcgcgaaatgccgcagcaacggcggcctgggcgggctcgaactcgatcactgagcgccgacgcggcgtgcgagccgggagccgtcaggccggtgcgcgcctaccacccgatccggtgcttctcctccgtctcgcgatgccgccagtcgtcgtccgcatgcaggtactggctcgtcgtcgtgagcgacacgtggccgaggttgtcgcgcacgagccgcaggtcgacgcggccgtcggccatgtgcgagcccgcgctgtggcgcagccagtgcgcggatgcctgttcgagcacgcgtgcctgctgctcgccggcttcgccgttcgcgcgcagccggtcggccgcgtgccggaacacctgcttcacgatccggtgcagcgccgcgcgcgtgagcggcttgcgcgcctggccgaccggcagcacgagcggcgtggactcgccgtcggacggcaacgcgggcaggccgtgcgcgcgccggtagcgcgacagctcggccatcatttcgtcggtggccggcacgagccgctgccggccgcctttgcccgtcacgtcgagccaccagcggtcgcgcccgtccgcgtcgcgccggcagaagaactggcccatcgtcgtgtcggccgcttcggtgatgcgcagcccgccgagatacagcagcgtgaacagccaccgcgcgcgatccgcatggaagcccgcccgcgcgtcgtcgcgcggcatcgcggcgatcgcttccttgaccgactgccacagcggttgcccgagatggcgcgtgacgcgcggtgcgggccgacgctgccgctggcgcgacaacgcgagcggattgccggccaggtaaccggcctgcacgagccacgagaacatcacgttcaggatcaccagcgcctgccgctggctggccgccgacagcggcccgtagaacggccgccagcgcggatcgtcgcgcggatgcttgcgtccgccgttcgcgcaccacagctcggccggcgcgggcgcgagcaggaactgccggtagacgatcagatcttcgtgcgtgagcgacgacagcggcttgccgcacgcgatcacggcccacagcaggcgctcggcttccttgcggtaattctggaacgtggtcggtgtgtcgacgaagcgcgcgagccaggcgcgcaccgcgtcgaggtcgttggtcgcggcaatctgcggatgcgtgccggtcgagcggttggtgcccgtgcgtccgtcgagcgcggccggcacggtcagcgcatcgatcggcagcgggcgcagcgcggcgtcggacggaacgggtgatgtcatgcgatgcggggagcgctgagcggatcgtacgcgtggaggcgggcggacgaacgcggcgcgatcaagccagtcgggaagcgtcgatggtacacgatcgtcacacgatgaacccgccgtcgacggcgatcgcctgaccggtaatgaagcgcgcagcgggcgagcacagccgcgtcatcgttttcgcgacgtggcggtgactcgccgagccgcgccatcggcgtggccggtatgcgttgcgccttgtcgtcgcggttttccgggcggccggtgctcgtcgaaccggcgatgccgccggggaacacgcggaaacggcactcgattccgtcgggcgtgcgcaggcccgcgctgggcgagatacggcggcagggccgcgggcgccgtggtcattcgggttgtctcctgttgcgggcaccgggccggcagggctgatcaggccgcgtcgcccggcgtgcacgtgcgagccgccggcggcgatgcgcgcggctgaaccggatcacggtaacggaccggcgcgcgcgacatcccacgaatgaaggtggcggccctgtttctgtaaggtgtttgtgaactttcccgcgacgaggatttctaatcggccctccaacgcttcctgaggaacatcagatgattcgccaatccagaacgctgctcggcgcggccgtcattgccggcagcacgctcctcgccggatgccagaccgacgcggtcgccacggcgccgaacgcggcgcgcccggccgacggcaagccggtgaccaggaccgtccaggtcgcgccgcaatccgcgcgatgcacgggcgtcgcgccgatggagtgcctgcaggtgcgaaacagcccgaacgagccgtggagcctgtggtacgcgggcatcgaaggcttcgcttaccagcccggataccagtacacgcttgaaatcgacgaataccgcgtggctcggccgccggccgacggctcgtcgattcgctgggtgctcaagcgcgttgtcgagcgccgtcaggtgaactgacggccgcgctcacgcggacgggcgcgccgcggcaccggccggcggcgcggccgtatcgatccgccggaacacgacggacgacagcagcgtcaccccacccatgcacgcgaacgacagcatgaatccgtgcgccatcgagccccgataggcggcaaacaggttgacgaggccgccgccgatcgacacgccgagccccatcgccagcatctgcatcatcgtgaacaggctgttgccgctgccggcgtcggcatgcgacagccccttgagcgtcacgccgttcatcgccgcgaactgcatcgaattcgcggtgccgaacacgatcagcagcacgctttccagtaccggcgcgggccgcaccgacaccagcgcgaaccccgcgatcgcacacccgacgatccccgtattcacgaccaggaacgccgcatagccgaagcgcttcacgagcggcgcgatccagcgtttcgcgatgaccccgcgatcgcggccggcagcatcatcagccccgattgcagcggcgtatagccgagctgcacctgcatcagcagcggcagcatgaacggcaccgagctcgtgccgatccggcacagcaggttgccgagcagccccgaaccgaaattcggctcgcggaacagcccgagccggaacagcggctgcgcgcggcgccgcgcgtacggcaggtacgcgagcgcgctcgccagcccgagcgccgcgagcccggccgcccatgcggcgcgatgcgcgggcatcggcgggtcgatcgcgagcgacagcgcgatcatcgcgaccgacagcagcgcacagccgacgaaatcgaagggcggcggttgtgtcgcctggtcgtgcggcaggtagcgctgcacggtgaggaagccgaccacgccgaccggcacgttgacgatgaacacccagtgccacgaaatcgcctgcgtgagccagccgccgagcgtcggcccgacgatcgggccgagctggccggcggtcgacacgaacgcgatcgccgcgacgtactgttcgcccggcacgcggcgcagcacggcgagccgcccgatcggcagcagcatcgagccgccgatgcccttggccgagcgtatgcgacgccgcgcagccgatcgatgcgagcacgaacacgagaatcgcaatcgagaacacgcggcgcgtgccgaaccggtcggccagccagccggacgccggcgtgagcatcgccatcgtcagcgtatagacgaccacgacgggctgcatcgcgagcggcgacgcgttcaggctttgcgcgatcgaaggcagggcggtgttgacgatcgtcgtgtcgagcgactgcatgaagaacgcagcggcgacgatccagagcagcgcggaaggcggattcgatggtgcgaaggccggcgcgggcggcgcgtcggcacggcgccagccggtcttcaagcgcacgatggtaccgattccgatggtcatcgggaagctgcctgatgacgttgactgtcattggaaacaacgatgacaatgcgggatgctcaatcccgtctggctcaagacgttcgcgaccgtcacgaactgccgcagcttcaccgaagcgggccggcagctcgggctcaaccagtcgagcgtcagcgaacacatccgtcgtctcgaagaaagcgtcgggcggcggctgttcgtgcgcgacacccattcgatcgcgatgacggccgacggcgaggcgctgctcgtgcatgcgaacgtgatcctgcaggcgctgaaccgcgcggaatcgcaattccgcaagccgaggctgcagggcctggtgcggctcggcgcgccggacgatcttgcgctcgtcgcgttgccggacgtgctggccgggtttcgcgccgcgcacccggacgtcgcgctggagatcaccaccggcatgacgagccggctctacgaagggctggacgcgggggcgctcgacctgatgatcggcaagcggcggctcggcgagcggcgcggcacgccgctcctgcgcacgcggctcgagtgggtcgcgcggcccggcaccgtcgtcgatccggagcgaccgctgccgctcgtgctggtcgccgagccgagcgtgacgcgcgcgatcgtcctgaacgcgctcgccgagaagggcatcggctgggaagtcgtgtgttcgagcagcagccagccgggctgcatcgcggccgcgcgcgcggggctcggcttgaccgcgacgtcgcactatttgtcgacgggcgggctggcgccgctggtcaacggcggcgcgctgcccgagctgcccgacatcgaattcatcgcactggccgccaagcggctcagccagccggcgcgcacgctgctcgaattgctggaagcgagcgacctgagcacaccgggcgcgaacgtgtaacgggctcgccacgcgcgacgcgcccggctccggcgcccgcgcaacgcgatgtgacgcgctccgtcatgcgaccgtcatgcggccgtcacgcagcccgcttctgcgaaatcaccagcagcgcgccgttcttgtcctccagcaccgcgcggtattcgtgcggcccggcctgcacgggcacgcgcaccgacgcgccggccctcacgacccgcgccatcgccgcatacaggtcgtcgtcctcgtcgacgcgcagcgtgagcgccgcgcgctcgacgatctgctcgtcgcccgcgaccagcgcgatcgtcagcgggccgccgtcgagcgcgcaataacgatcgccgtcgcggaacttcacgttcaggcccagcccgtcgacgaacagcggcagcgccgtgtcgatgtcgtcgacgggatacagcagcatcgaaaccttcatcccggatctcccttgtcttgatgtgggcggcatgcaacgtgccgccgttcgatgctagcgcgccgttcgtgcgctcacgcagtccgatcggatgaccgtgaaacccctctgtccccgcatgcgtgccgatactccgaacagacgatgcccgcgcccggccgcgcgccgacactcccatccgtggaccgtcgctattcgtccgtatcgtgcgggcgggctgcgcgaccccgactcgtccaacatacatggagacgcacgcaatgaagttttccctcatctacgaagcccagaccaccgacgcatcgcgcgagggcgaccaccgggtgttcaaggagacggtcgaacaggcgctgctcgccgagcaggtcggcttcgacacgatctggtgcgtcgagcacacgtcgctgaccaactatgcgcacatgagcgcgccggaaaccttccttgcgtacctggccggccgcacgacgcgcatcggcctcggccacggcgtcgtgtgcctgccgcccgcgatgaaccacccgatcaaggtcgccgagcgcgtcgcgctgctcgacatcctgtcgggcggccgcgtgcacttcggcgtcggcaagggcgggagccagcaggaagccggcgcgttcggctacgacctcaacgagctgcaaccgatgatcgacgaatcgatgtacctcgtgccgaagatgttcgtgcaggacgagatcgagcacgacggcaagtacatcaagatcccgaagcgtccgatccacccgaagccgttccaggacccgcacccgccgatgtatctcgcgtgcaccaacaccgacgcgctgctgcgcgccggccagcgcgggatgggcgcgctggtgctcggcttcggcggccccgatgaagtcgcgaagaagaacgccgtgtatcgcgaagcgtgggcgaaccgcaagccggaagaccaggtcggcttccgcccgacccagcacctcgcggcgctgtgcccgacggtcgtgatggccgacggccaggccgcccgcaagatcggcatccgcggccagcgctacttcatggaatcgctcgcgtactggtacacgggcggcgagcgtccgacccggcgaagtggggcgacgacctcgtgcaggccgacaccggcgagatggtgatccgctcgcgcttcgcgtcggaggaagtcgtcgtgaacttcgccgatccggcgctcgcaatgatgaacccgaaccacgcgtacggcacggttgacgactgcatcggctatgtcggccgcctgcaggaagccggcgtcgacgaagtgctgttcctgtgccagatggggacggtgccgcacgaagcgcagatggagacgatccgcaatatcggcgagcacgtgatcccgttcttcaacaaggagaaggagcgtgcctgcgcgtaaggcgggcgggccgcgcccgtcgtcccgtccggtcggacgatgcggcgcggtcgcgcgaagccgaccatcggtggtggcgagcatcgcccgcggccaggccgcgccggacaactttgaacgagagcggggcgggcgccgcggcgcagccccgttccacaggagacattcgtgcatcgcgacaacgattcgaacgcattggccgccacgctgatcgcccgggccgaggcgctggcgccgacgctggccggccgcgccgcgcaggcggaagcgcagggccgcatcccggccgagacgatcgccgacatgcaggccgccggtttcttcaaggtgctgcagccgaagcgctacggcggctacgagctcgatccgcaggcgttcttcgacatccagatggcactcgcgcgcggctgcatgtcgaccgcgtgggtgtacggcgtcgtcggcgtgcacaactggcagctcgcgctgttcgacgcgcgcgcagcaggacgtgtggggcaacgacccggcgacgctgatcgcgtcgacctacatgccggtcggccgcgtcacgccggtcgacggcggcttccgcctgtcgggccactggaagttctcgagcggcagcgaactgtgcgaatgggtgttcctcggcgcgctggtgccgccggccgaggccggccagccgcccgaataccgcaccttcctgctgccgaaatccgattaccggatccagcaggactgggacgtgctcggcctgcgcgcgacgggcagccacgacatcgtcgtcgacgacgtgttcgtgcccgcgtaccgcacgcacaaggccatcgacgggatgatgggcacgagcccgggccttgccgtcaacgacgcgccgttgttcaggctgccgttcgcgcagatcttcgtgcgcgcggtgtgcacgtcgtgcatcggcgcgctgcagggcgcgctcgacgatttcaccggttatgcggccacgcgcgtatcggccaacagcggcgcgaagacgaccgacgatccgggtgcgcagaacgcgtgcgcgaacgcggccgtcgcgatcgacgagatgaaggtgctgctcaagcgcaatttcgcggaactgatggcgtcggtgacgggcgggccggccgtgtcgatcgagcgccgcgtgcatttccgctaccagtccgcgcaggtcgccgagcgctgcgcgcaggcggcgaacgcgctgctgcgctacgcgggcggcaacggcatctatcaccgcaatccgctggtgcgccgcttcctcgacctgcatgcggcccgcgcgcattacgcgaacaacgtcgaccgtttcggccagaacctcggcgccgtgatgctcggccgcgagaacaccgacttcttcatctgacggagacgcgatgaacgacccgcaagcacaacaatacgtgttcgacgtggtagtcgtcggttcgggcgcgggcgcgctgctcgccgcgtgccgcgcggccgaccgcggcctgtccgtcgtcgtgatcgagaagacggcgctgtacggcggcacgtcggccgtgtcgggcggcgggatctgggtgccgtgcaaccaccacatcgccgaattgggcgcgaccgattcgcgcgaggccgcgcgcggctatatcgaagcctgcgtggccggcgcgtcgacgcccgaagctcgacgcgtatctcgaccgcgcgccggagatgctgcgctacctcgaatcgaagaccccggtgcgctaccagtcgctgccgaagtacgcggactatttccagaaggtgccgggcgcgatgccgggttatcgcgcgctcgatccgctgccgttcgacggcggcctgctcggcgacgagctcgatcggctgcggccgccgtcgcccggcacgctgatcggcggacgtgtggcggtgacgtcgaaggaggcgcacacgctgttctcgcgcgggcccggtttcatgacgctcgcgatcgcacagttcggccgctattggctcgatatcgggatgcgccgccgcacgcggcgcgaccggcgcctgacgctcggcaatgcgctgatcggcgggctgcgccgcgcgctgctcgagcgcaacgtgcccgtgtggctcgacacgccgatgcgcgacctgctcgacgtggacggccgcgtgacgggcgtgcgcgcgcagcgcttcgggcagcccgtgacgatcgccgcgcgacgcggcgtgatcctcggcgcgggcggtttcgagcgcaaccagccgatgcgcgaacgctacctgccgcagccgacgcaggcgcagtggagcgcgacgccgcctgccaacaccggcgatgcgatcgccgaaggccatcggctcggcggcgcgctggcgctgatggaacacgtgtggggcgcaccgacggtcggggtcgccggcgaggagaaacagcgcgcgctgttcgtcgaacgcaacctgccgggctgcgtgatcgtcaacggcctcggcaagcgcttcgtcaacgaagccgcgccgtattccgaattcgtgccggcgatgtatcgcgaccatgcgcgcaccggcacgagcgtgcccgcatggatggtgttcgacgcgcggtttcgccgcaagtatccgtgcgggccgatcatgccggcgtcgatgatgcccgatgcgcggattccggcggcgtttcgcgacgtgctcgtgaaggccgacacgatcgacgcgcttgcggcgcgcatcggcgtcgacgcggtcgggctgcacgacacgctgcgcgacatggcgcgctacgcggcgaccggaatcgacgaggcgttcggcaagggcgacaacgcgttcgacacgtactacggcgatccgcggaacgagccgaacccgtgcctcgggccggtcgaccaggcgccgttctacgcggtgcggatcgacgcgggcgacatcggcacgaagggcgggctcgtcaccgacgcgctggcccgcgtgctgcgcgccgacggcgaaccgatcgccggcctttacgcgatcggcaataccagcgcgtcgatgatgggcgcgagctaccccggcgcgggctcgacgctcggcccggcgatgaccttcgggtatatcgccgccgatcacctggccgcgcacgcggccgacgccggcggccggccggctcggccatccacgactgaacttgacggagtcaatgatgagcgatctcacccccatccgctgcgcaccgacatgctgctcgcgatgcgccgcctcgcgcgctccgtcacggtcatcagcagcgcgcacgacggccggcgctactcgatgtccgcgacggcggtcgactcgctgtcgaccgatccgccttcgctgctgatctgcatcaaccgcacagcgtcgctgtatccgccgctcgatgcgggcgccccgttctgcgtgaacgtgctgtcggcccgccacgaaggcatcgcgatcgactgcagcggccgcctgaagggcgaagcgcgcttcacgaccggcgactggcacacgtcgccgcacggcgtgccctatctgcgcgattcgcaggcgagcctcgtttgcgagcaggacggccgcttcgaatacggcacgcatacggtgttcatcgggcgcattcgcgaggtgctgatgtgcggcgacgtcgatccgctcgtctatctcgacggcgcctacacgacgcccggcgcgccggtggcccgtgcggccgcgtgacgtgaggagccggcgatgagcgattcgcgcttccatcggctgaccgttgccgaagtgattgctgaaagcgacgacgcatgctcgttcgtgttcgacgtgccggccgcgttgcgcgacgcattcgcataccggcccgggcagttcctgacgctgaacgtgccgtgcgcggacgcggccgttgcgcgctgctattcgctgtcgagcgcgcccggcatcgacgccgcgccgaagatcaccgtcaagcgcgtgcgcgacggccgggcgtcgaactggctgtgcgaccgcgtgcaggcgggcgacacgctcgaggtgctgccgccggccggcgtgttcacgccgcgcgagctcgatggcgacctgctgctgttcgcgggcggcagcggcatcacgcccgtgctgtcgatcctgaaatcggcgctcgtgcacgggcgcgggatgctgacgctgatctacgcgaaccgcgacgaacgctcggtgattttccgcgacgaacttcagcagctcgcgcagcgccatcccgggcgcgtgcgcgtgatccactggctcgacagcgtgcagggcattccgcagcagcgtcatctcgaggaactcgcgcggccgttcagccggcaggagacgttcatctgcgggcccgcgctgttcatggagaacgcgctggccgcgatgctcggcctcgggctgccgcgtgcgcgcgtgcatgtcgagcggttcgcgtcgttgcccgatgcgccagcgccggccggtaccgcggcgcaggccgtgacaacggcgattacggcgacaacgtcggtgcccggcgacggtgcggcgatcgagacggtgctcgacggcgacgcgttcgcgttcgacagcgcgcccggcgaaacgctgctcgacgcgatgctgcgcgcgggtgtaccggcgccgaattcctgccggatggggcaatgcggcgcgtgcatgtgccggatcgagcgcggcgaggtcgcgctcgacagcaaccacgtgctcgacgacgacgagatcgcggccggctggacgctcgcctgttgcgcacggcccgcgagcgacgcactgcgcgtcgtgtttcccgactgagccgacgcgcgcggcggcgcgcggccaccctgatctatgacgatggacaacgaaatcctgaccacgcccgcgctgatcgcacgggcagccgcgcgccacggcgcgcatccggcgatcgagtcggagcacggccggctgacctacgcggaactcgacacggcccgcctcgacgcggcccgcgcgctgctcgcgagcggcatcgaggccggcgaccgcatcgcggtgtgggcgccgaacctgccgcaatggatcgtcgcggcgctggcgatccacaccgtcggcgcgatcctcgtgccggtcaatacgcggatgaagggcatggaggtgggcggcatcctgcacgacggcggcgcgcggctgctgttctgctgcggcacgttcctcggcgagtcctatccggcgatgctcgcgccgcatcggccggcgacgctcgagcgcgtcgtcgtgttcgatggcgaaccgccgcccggcgcgcacgacgagacctggaacgcgttcctcgcgcgcggcgccgaggtgccgctggacgcggtgcgcgaacgcgaggcacaggtgacgcccgacaccgtgatggacctgatgttcacgtccggcacgacgggccgcccgaagggcgtgatgaccgcgcacggccagaacctgcgcgccgcgcaggcgtgggcggcgatcgccggcgtgcgtcctgacgaccgctacctgatcgtcaatccgttcttccacacgttcggctacaaggcgggctggctcgccgcgctgtcgagcggcgcgaccgtgctgccgcatctcgtgttccagccggccgacgtgctgcggcgcgttgccgacgaccgcatatcggtgctgcccggcccgccgacgctgtactacgcgctgctcgacgcgcccgatcgcgcgacgcgcgacctgtcgtcgctgcggatcgcggtcacgggcgcggcggcgatcgccccgagcctgatcgaacggatgcgcgccgagctcggcttcgagaccgtgctgaccggctacgggctgaccgaatcgtgcggcttcgcgacgctgtgccgtcaaggcgacgatgcgcagacggtcgcctgtacgtccggccggccgatgccggatgtcgaattgcgcatcgcggggccgggcggcgcgccgctcgggccggacgagaccggtgagatctgggtgcgcggctacaacgtgatgcgcggctatttcaaccagccggacgcgacgcgcgaaaccgtcgatcccgatggctggctgcatacgggcgatctcggctgcgtcgacgcgaacggcaacctgaagatcaccgaccgcatcaaggacatgttcatcgtcggcggcttcaactgctatccggccgagatcgagcggctgctcgccgcgcatccggcgatcgcgcaggtcgcgctggtcggcgtgcccgatacgcggctcggcgaggtcgggcacgcgtatgtcgtgctgcggccgggcgcgcatgccgacgccgacgaactgaacgactgggcgcgctgcaacatggcgaactacaaggtgccgcgttatttcacgttcgtcgagcaactgccgacgagtgcggccgggaaggtgctgaagtaccgcctgcgggcggggaccgaggcggcggcctgagcgccgccgtacacgaacgggatgaacgcatgaacgacaacgggtttccgcagggtgcggtgctggtgttcggcggcagcggcgggatcgggcagggtgtcgcgctcgagttcgcgcgggccggcgtgccggtcgcggtgggctaccgcagcaaggccgacgtggccgagcgggtcgcgcgcgacattcgcggcgagggtgtcgcagccaccacgcactgcgtggacgtgaccgatcccgcacaggtcgacgccgcgctcgcggctgcgatcggcgcgcatggccgcgtgcacacggtggtctgggcggccgggccgttcgtgaaccagcgtcatatcggcgacatgacacacgacgactggcgccgcgcgatcgacgtcgagacgatcggcttcttcgtggcggcgaaggccgcgctgccgcacttccgcgcgtcgggcggcggatcgttcgtgacgctcgggtcggccgggcatctgcgctggcccgaccgcgacgggctgtcggtcgcaccgaaggcggcgaacgaggcgctggtgaaagggctggcgcgcgaggaagggcgctacgacattcgcgcgaattcgatcctggtcggcgtgatcgaggccgggatgtttccggtgctgctcgaacaggggcagttcgaccaggcgtggatcgacgagacgcagaagatgctcgcgctcaagcgctggggaaggcgcacgatgtcgggcgggcggcggtgtttctggcgtcggatcgggctggttacattaccgggcagcagttgaatgtttccggtgggtatgggttgtagcggcacgccgaaatggcaaattcattcggacaaccgtatctgaacggtcggtagttttgcgcgcggatatcgcgcgccatcccttccgaaaatcatcgacgacgcgggccgatataccgatcggctcgcgtatcgcatctgtgccgggcacggacagatggatgcgcacgcatcggtattcaccctgcctcgtcacgcacgatcgtgcatcggcatcgcgtgcgcccgcccaaaggtcacacttttgcaacgcttttccggcgtattcctctggacacgattgatcgtcgtggcgacgcgcgtgcgctgacggccgtccggcctcgttccgcaggcgctgcgcgatcgacgcgcaattccgccaatcgcgcctttcggctcggcgcgccggatacggatacgttcctgaaacatttccccaccattgcgccccgcgttgccgcccgtgcgacgcggacacgcttttcccgcttcgatttgcgccgcatggcacgtgccttgcggttgacccggtgccgccggcgcaaacgaatttcgcgagaacgacgaacgcgtcggcggcatgcaacgacatcgaaacaaacggggaatcggatcgggccgcgggcgtcgcctgtcgcgacgtacctgccgcgcatgtcgtatcggtcatgcgcgtgggcaacgtgttcccgatccgtcgaacagcaagcgtgcttgcaaggtgtcgtgccggggttcgcatcacgcatggcgacgcaggccgcatgcgttggcgaggcgcgcccggcacatgtcggggaggcgcccgtgaaaacgacagtgaaccaatgggcattcgtcgcggtggtgttcgccgcgagtgcgcatgcgcaggaaatctacctgcagggcggcacgcagggcgtgggcatcggcgcggccgtgagcttcaattcgatgctcggtgcgcatgcggatttcaatgcgatcgatctttcgcatgacttcacggtggccggcaatcgctaccaggacgacctgaagctgcgccagggcggcttgtacgcggacatctttccgtggcgaggcagcggcttccgcgcgacgctcgggctacgcttcaacgacgacgagcttcgcggcgtatcggtgccgaccaatggcacttacgtgttcggcggcaagcgttatccggcgcggccggggatgtacgcggtggccgaagcgcgctatccgaccgtgatgccgtacttcgggatcggctacgggcaccggccggcgtcgaaagggctgggattcgtcgccgacctcggcgtcgcgtacgggataccgaaatgctcgtacacgctgtcgccggagctggcggccgcggccgggcccgcgaagagccagatcctggccgcgagcgggctggattcgctgcggcaggtgatgtcgcgctaccggtggtatccggtgttgcagatcgggatttcgtatcggttctgagcggcggggcgtcgttgcgtgtgccgggcggggaacggccggcatcgccggtacgggcgggccaacggatgttggcacgggagggccgacgaccctcgcgagcaccgctcgcggagtcggtgaatgcagccgtcccgcatcgatcggcgcgcgcccgcgcaggccgttcagccgtgaatagccgatcggccgtctttcccgccgttccgatccggcttacctttcaaacagcagttcgacgtgtcgggcgagcggcgcatgccgaaagggttcatgcggcccgttgccgttcgctgacgccaaccaccgtcctccttccgttgttggcgatgatagcaatgattgcaattcccggtcgtggcgctatcattgatatcaatctggaaggagggaaccatggcaaatctactggtgcgtaacgtggatgacaatatcgttcagagcctgcgcgagcgggctgcggcaaatggccggagtgccgaggccgaacatcgggccattctggccgatgcgctcggccggccgaagcgaaagacatttgcgcaagtgctgatgagcatgcccgatgtcggcgaagacgcggattttcaacgtattcaggattccggcgaggccaggcgtgtatttgattgaagcgttcgattggccggaaacccttgtcgcataggcacggcttgagaggctcttccagtaacaccaagtcaacttttcgcgcagcgatggcgagcgacggaatttggccggtggtagtttcttgccatcgccggcaactgatccgtttgcgacggccgagcagaacgacgtcaaactcgatatcgggggcaagcacgacacgtgggactatttgttcacgggcaaccaaaggtactcgaagcacccggctaatgtcgtccagtgggaaacccgcgactgggatcccgatacgcgacccaatggtgatcggagcaacagtttgaacccgaacaatcgggcctcaaaggtagcgacagataatcgggcgaatcaactgaatcccaattttcctgagtacaaggtgcgttgagtggtcggcatcagctttgctcaagttgcagccagcatggccggtgagcaaagtattgttctaaggtacggggatgctcaagtacatggttggggttggccgaattgagtcagtcgatctgacggtcttcgtttaccggattcattcttgtacacatttagtggttttaaacccgttttcgtttcgctatattgacgacgtcggacgcgaggtgcgcttaaatggcgcccacccgggaagccgcgtgggcttcttcattacagtccctctgaaattaaagtcatgcggtttccggtgggtttcctataaatatacttaccccgatacggggaataacaaggagaccacaacatgaaaacagcatcgtttgtttgcgtggttgctggggtgttgacgctgaccggatgcgggatgttttcgccaccgccagtccgaccgagcgacattacggttgagcaagcgttggcctcggtggggacgggctggcagtgttcaagaagaagctagactcgaacaacatgaaactgggcatgtatgtcgatacgatcaatttggaattggatctaacgacagatcagaagggcgacggaaagttgtcggttgacttctcgaaaggatttcagcttggtccacagttgggcatggagcaaacggtggacgccagccgcggaagtaagttggtcataacactgaagcaagctatggttcccatcaaacagagccaagatgcggctcgtgatgacggagccggacacgcaggagcccacgcgcaagctccggcaaatccgcatgagaagacgcagaatggccaaggcggtacttccgaaggcccgtcaaaggttccgttttacgtgccgtggaagattctcgggcaagacccgcaaatttaagtcccggttacttgacttcgaagctcgtcgaacggtttccgacgagcttcttttcgtttcttcacatgtcgaggcgtttggtctgaaggccagccagcgagggggcgtggagccgcgtcatggctagtcagggtgactggtcggctgttcgatcgagtcggcggcggggaaccgaggtttccgttggagtcctaccttgtaggatatcgatgtgctccttcgcttaagtcaaaacgtccatcatttgcgtaacaaaacgactggaggaatgcatggcgacctacaaggaactgaaagcccaagcggaggcattggccgagaaagcagaggctgcgcgccgggcggagatgaaatccactatcgatgacattcgtgccaaggtcgcggagtacggtatcaccgagacggacatcttcggtgcgcgtcgtggcaagtcatcaaagcaaccgaaggcgctgacggaggcgaaataccgcgatccgaagaccggtgtgacttggtcgggccgtggtcgcgcacctgtttggatcaaggatgccaagaatcagaatcgattcctgatccaagggtaagtctgtttagtaacttgggggtgtaaactcgctcgcgtttcgttatattgacgacgtcgggcgcgaggtgtgtccaaatgaggcctgccggtattgccgagcaggtttttgttttggtatttcctgtttcgtctaccattgcatggctgagcacaagctcggtgttcaaaacatgacgataatggggagcaatgacgacaatggcgcaggccattcgagagttcgtgggttccgcggaggctggagtcacgtcctcggagatccggaagcacatcacaagcacatatggcgatcagtggaaagcgagcacgctttcggcacatctgtacgggtgctgcgtcaataaggcgcgggcgtatggcgcatatccatccgcgccaaaatttttgtacaaggcagccgacgggcaattccatctctacgacgaagaagtacacggacccaacgtatggcagccgattgatgatgtcaccgaggacgagtttgagcagacagagtccgtcgaggagttgatagaggcgtctgtcagcttcgagcgcgacgtcgaagcacatctcattcagaacttgggcgcggttgaaccgggtctcagatatgttgatcggcaggtctcgatcgacgttggccgtgttgacattcttgccgaggatgcgtcaggtcgccgggtcgtcatcgaacttaaagtgggagaggcgaaggacgcggcagttggccaaatcgcacgctatcttggatggtatgcgaaacgtgatggaaagccaccgcgcgggatattgattgccagtgagttttcggagccgatccggtacgcgtcagaggcaattcagaatctcgaactgatgacgtacaaagtgcagttcgcgttctcgcgcacggtcttggaataggaagaaatttccgtgctggtcgttcatgcgcctgctaggttagaggctatctggagtctttgatggaggccttcattgacaaaagtattcctttccggtgctgtcctttttcttctggcagcctgtactagtaccgacgaagccgtgcactggatgaaggggcatccggtacatgatgtgaagatcggaggctatgctttttcgcgtgtaacgggacctcgagagtgggccgcacttactcggcgattgacaataagtccggtgagcgtgttcgaggcacgatctgcacaaaccttgataacagtacgtcggatatcactgaagtaaaggacacccagtaaaacgatcgatctgagacagcacgcggccgcaagacgaaactcttgcggtttttttttgcacgacggctaacgatgagggttcgtctatgccgcgacctgtaccgcgacttcacatggaagccgaagagctaccaggactacctagcgccgatcgtcgcaaacgccgagggaaagctcagaccattggctgccggcttcggcttctggtcgcgcgctgcggaaggcaaacattgaaaaggcgaatgagcagggccgcaaaccgccgatcgtccacagtacgatgaacgtgcgcgacgacatcttcgggatccattccatgcccatcgtccgaaattgagattttgatatcgtcggggagggtaataacaacagggtgaatggatcgcgcgttcctgcgtcaacttcctgtttcgcggcaactctcacagttgcacgcgcggcaaggatcctgtcgaacggaattttgatgttgaccccgggcacctcactgccgtacgcgtttgcaacgaactcgaccatactcttcgcaagcgttgcgtacatgttgatacccagcgcgtcgagcatgctgccctggattttcataccgaactctgtcggcttagccttcattcttccccgaatgtggcgtagtgtcacttgggtcgtgttgctgccaagaaggtagggtatccgactgacgggacggtgccccgtcggacccgtagtgacattctcccgatccgggcgtagtgtttcgggcaagcgcgcgtaagcaagattgagtattcagatgcgctgccggcacaagtcgaaaactcacgatcatatgaccggggaagatcatgaaagacactacacgcgcgcgtgttgccgcggcagtgggagccgcggtgcttcggaaaaacgtgacatcggtctacgactattcgtcaggggatataagagcatttctgccagtgtggggaatggctcgctgaacgggtatgactacacgacgtcaagttacttcacgggaagcagtggtacatcgctggatttttacgactaccacagctcgaagcatgtactgctgaacctgaagaacggcagcttcgatgggtacgactacgattcagggagcacttcagcggtacggtcaatgggaactcgatttcgttgtatgactacgaaacgagcaaacactacaactatgctgtttgactcgcgtaggaggtttcaacggatgtccagatccggattgacgagacgagcgatgaatcagccgtcgaaagctgttcagaacacacaggcaagtgcttgattcttaaggcggcaaggtgcccactttggtgggtaatttcccgccgaaatgtgcatataaccgtttgaaatcacaagaaaaatgtcgaatcgcccagcctatttgattgataccaacgtcatcagtgaaatcaggaagggcaagcgaaccaaccgtggcgtgcgggcgttcttcaggcaggccgcggcggacgccagcccgctttacctgtccgtcgtgacagttgctgaacttcgccgcggcgtcgacctgatccgtcatcgcggcgatcaccccaggcgtcggcgctcgaggcgtgggtggcaaccatcctggccggctatgcaccgaacatcctgccggtcgacatcgagatcagccagacgtgggggcatttgcgcgtgcccgatccgacgcacgaactcgacaagctgatcgcggccaccgcgctgatcaacgatctcaccgtggtgacgcgcaacgtcgcggatttcgcccgcaccggcgtcaggttgctgaacccgttcgactgatcccggttgccgcgtcgcggcaacctgtcccggctctccgtctccttccgcaggcatggcccgttccgccgggcagccgcgcgcgtctgcaccgctccgattccccgccgcctctcgtcccaacagacgatgtaacaccaccccgaccggccagaatcctttcacgaacaacggattctgaaccaggaggaggccgacatgatcgatgtccgtgcgcttggctatgtcgtcgtcgaggcgacgcgcgtcgatgcgtggcgccgctacgcggaagacgtgctgggcatgctggcgctcgacgcgcccgacggcgcgttgtacctgaagatggacgagcgcgatttccgctacgtgatcgtccccggatcggccgaccgctatttcgcgtcgggctgggagctgcccgacggcgccgcgttcgacgccgcgctggcggtgctgcagcgggcaggcgtcgagccgatccgcgcgacgcccgccgaagccgcgctgcgccgcgtgcaggcgatggcgtggtgcaccgacccgtccggcaaccgtcacgagctgtactggggcgcgcgctgcgatttccgccgtttcgtgtcgccgctgggcgtcgcgcacttcgtcaccggcgacatggggctcggccacgcggtgctgcccgcgccgcagttcgacgcgaccgacgcgttcgtgcgcggcgtgctcggcttcgagctgtccgacatctatcgcgtgaaattcacgcccgatcccgcggaacccgaaaagcgcatccacttcatgcactgccgcaacgcgcgccatcacaacctcgcgctgttcgagatggccgtgccgtcgggctgcgtgcacgtgatggccgaagtcgactcgatggacgaagtgggccgcgcgctggatcgcgtcgccgcgcacgacgtgaagatgtccgcgacgctcgggcgtcactgcaacgaccagatgatctctttctacatgaagacccccggcggcttcgatctcgaatacggcttcggcggcctcacggtcgactggtcgaagcacgcggtgttcgaggccacgaaggtgagccagtggggccacgatttcagcatcggataccggtgagccagcaggatgacgatgaaatctctcgacaagacgatgtccgcgcgcgacgtggtcgcgcaactcgccgacggcatgacgatcggcatcggcggatggggccgcggcgcaagccgatggcactggtgcgcgaaatcgcgcgctcgaacctgaaggacctgacgatcgtcgcgtacggcggcgccgatgtcgggctgctgtgcgcggccggcaaggtacgcaaggtggtgttcggcttcgtgtcgctcgacgtgatcccgctcgaaccgcaattccgtcgtgcgcgtgaacagggccgcatcgacgtgctggaactcgacgaagggatgctgcagctcggcctgcgcgcggcggccgcccggctgccgttcctgccgacgcgtgccgggctcggcaccgggctgctcgatcatgcgccgcaactgcgcacggtgcagtcgccttacgacgacggcgaaacgttgctcgcgatgccggcgatcgatctcgacgccgcgctgctgcacgtgaacgcggccgaccggatgggcaatacgcgcatcgacggccccgatccgttcttcgacgcgtggatggcacgcgccgcgcagcgttgctacgtgtcggcggaaacggtcgacgcgtcgctcgcgagcgaagacctcgacgcagcgaaacgcaatccgttcgagcgctcgctcgtcaccggcgtcgtgcacgcgccgggcggcgcacacccgacgtcgtgcgggccggcctacggctgggacctgccgcacctgcgcgcgtactgcgccagtgcggaagacgacgcgaagacggcggcgtacctgcgcgacgtggtcggccaggacgaacgccagtacctcgaaggcgtcggcgggctgtcgcacgtgacgacgctgccgttgccgattctgtaaaggagcgcctgtgagcgaatctctcgaccattccctcgcggaactgatgatcgtcgcatccgcgcgactctggcgcgacgacggcgaagtgctggcgaccggcatcggcacgggcccgcggctcgcggccggcctcgcgcggcttgcgtacaacaacgggctgatgctgaccgacggcgaagcgtatctcgtcgaggagccggtgccgctcggcccgcgccccgacggctaccgcgtgaaggcgagcggctggatgacctacgaacgcgtgttcgactgcctgtggcacggccggcgccatgcgctcgtgatgccgacgcagatcgaccgtttcggccaggccaacatctcgtggctcggcgacgactacgcgcgcccgaaaacccagctgctcggcgcgcgcggcttcccggcaacacgacgaaccacgcgaactcgttcttcgtcagcggccacggcgagcgaacgttcgtcgcgggcgaagtcgacatggtgtgcactgtcggccacaacccggcgcgccggctgcccgggatgaaaaccttcgtcgacctgcgcagcatcgtcaccgacctgtgcgtgatggatttcggcggccccgaccacgcgatccgcgtgcgctcgctgcatccgggcgtgagcttcgacgaggtgcaggacgcgacgggcttccgttgatcgcgcatccggagctcggcacgacggccgcgccgaacgcggaagacctgcgcatcgtgcgtgcgctcgatccgcacaacctgcgcgcgacgatcgtgcgcaacaatccggcgccgcgccggggatgaggttccacatggaagcgacccagatgacgttcggcgacggtgtcgtcgactacgcggtcgacgccggcatcgcgacgatcacgatgaaccgccccgagtatcacaacgcgcagaactcgaagatgacgtacgcgctcgacgcggcgttccggcgcgcggcgcacgacgacgcggtgaaggcgatcgtgctcgcgggcgccggcaagcatttctcggcgggccacgatatcggcacgccgggccgcgacatccacgagtcgttcgatcgcgcatcgctgtggtacgaccacgtcgacaaggacggcggcgaattcctctatgcacgcgagcaggaggtctacctcgggatgtgccggcgctggcgcgacctgccgaagccgacggtcgcgatggtgcagggcgcatgcatcgcgggcgggctgatgctcgcgtgggtgtgcgacctgatcgtcgcgtccgaggatgcgttcttcgccgatccggtcgtgcgaatggggattccgggcgtcgagtatttcgcgcacgcctacgaactgaacccgcgcatcgcgaaggaattcctgttcctcggcgagcggatgccggccgagcgtgcgtaccagatggggatggtcaaccgcgtcgtgccgcgcgaacggctgcacgacgcgacctatgcgatcgccgcgaagatcgcgacgatgccgcgcctcgggctcgcgctgaccaagcaggcactgaatcacgtcgaggaactgcagggcaagcgcgcggcgatggatgcggcgttcgcgtggcatcacttcgcgcatgcgcacaacgagctcgtgagcggcgaccgtctcggcggctacgacgcgcgcagcatggccagttcgcagcgtcagccgaacggcgttgatcgcggcgacgcgcccgcaccggtcgccgtcaacggagcggccgcatgagcacgacgcttcagacgcttcaaagcccgctgcatacgcctctgtgcgacctgctcggctgccgctatccgatcgtgcagaccgcgatgggctgggtggccgacgcgcggctcgtcgcggcgaccgcgaacgccggcggcttcggcttcctggccggcgcgacgctcgaacccgagcaggtcgaggccgagatcctgaaagtgaagtcgctgacggacaagccgttcggcatcaatttccacatgttccagaagaacgcgcagcaggttgtcgagctggcgatccggcaccggctgcgcgcggtgagctacggccgcgggccggatgcaaagacgatccgccgcttcaaggacgccggcatcgtctgcatgccgaccgtcggcgcaccgaagcatgcggtgaaggcagtcgagctcggcgcggacatcgtgacggtgcagggcgcggaaggcggcggtcacacgggctccgtgccgaccacgctgctgctgccgaaggtgctcgacgcggtgcgggtgccggtggtcgcggccggcgggttcttcgacgggcgcgggctggctgccgcgctcgcgtacggcgcggccggcatcgcgatgggcacgcgcttcctgatgagcgccgaatcgccggtgccgcgcgagacgctcgaacgctacgtcgcggtcggcgacccggcgcgcatccgcgtgtcggacgcgctcgacgggctgccgcaacggatgatcgacaacccgtacctgctgaagctcgagcgcttcggcccgctgcgccgcacgctgttcgcgctgaagacggccgacgcatggcgccgccagaacggcctgagcacgggcgacatgctcggcctcgcgatcaaggcgctgcgctcgcacgactacacggcgagccagacgctgatggcggcgaacgcgccgttcctgatccagcgcgcgatcgtcgaaggccgccccgatgaaggcgtgctgccgagcggccaggcggccgcgatgatcggcgcgatcgaaccgtgcgacgcgctgatcgcacggatcgtcgcggaagccggcgagcgactcgacgcactggccgcgctgcgcggcacggcggcagcgcaggccgcatgaacaacatcacagggaggcaatggagatgacaggatccaaccaaccggccggcgcgatgccgttccggatcgatcgcgccgacggcatcgccgagctggtgatcgcccatccgcccgtgaacgcgctcgacgcgcagggctggcatgcgctttcccgcgcgctcgatgcgctcggcgaggacgacgaggtccgcgtgatcgtcgtgcgcggcgaaggccgcggcttctgcgcgggcgtcgacatcaaggagctggccgcgcatccggagcggatcgtggcggtcaacgcgggcaattacgagacgttccgcgcggtgcaccgcaacccgaagccggtgatcgcggccgtgcacggtttcgtgctcggcggcgggatcggcatctgcggcgcggcggacatcgtcgtcgcggccgactgcgcgcgcttcggcgtgcccgagatcgaccgtggcgcgatgggcggcggcgcgcacctgcagcggctgttcggcgtgcagaaggtgcgcgcgatgtacttcacgggcgagatgatcgacgcggccgaagcgtaccggctcggtgcggtcgagcaggtcgtgacgcgcgacacgctgcgcgatgcggcgctcgcgctcgcccgcaagatcgcggacaagagcccggcgatggtgcggctcgcgaaggaggcgctgaacggcgtcgaggacggcgatctcgaggacaagtaccgctgggagcagggcttcacgctgcaggcgtacatgacgaacgattcgaccgaagcgcgtgccgcgttcgtcgagaagcgcaacgcgcgtttcgatgcgcaggccaccgtcgaggaggcacgcgcatgaacctgacctacacgccgcagcaacaggcgtttcgcgcggagatccgcgaatggctcgccgcgcacgtgccgcgcgagcggctgccgagcttcgacaccgaggaaggcttcgccgcgcaccgcgaatgggagcgcacgctgcactcgggccgctggagcatggtcacgtggccgcgcgagctgggcgggcgcggctgcgacctgatcgagtggctgatcttcgaggaagagtactggcgtgccgacgcgccgatgcgcgtgaaccagaacggcatcttcctgctcggcccgacgctgatggatttcggcaccgcggagcagaaggcgcgtttcctgcccgcgatggcggccggcgagcacgtatgggcgcagggctggtcggagccgaatgcaggttccgacatggccgcgatccgcacgacggccgcccggatcggcgacgaatacgtattgaacgggcaaaaatctggtcgacgcgcgcggtgtgggccgactggctgttcgggctgttccgcagcgacccggaatcgtcacgccaccacgggctcacgttcctgatggtgccgctgtccgcgccgggcatcacggtgcggccgatccgccagctgaacgggcagacgggcttcgcggaaatcttcttcgacgacgtgcgcgtgccggtcgagaaccggctcgcggccgaaggcgcgggctggcaggtcgcgatggcgacggccggcttcgagcgcgggctgatgctgcgttcgcccgcgcgcttccagcgcaccgcgcaggcgctgcgcgacctgtatctcgcccaccgcgacagcgcggatcgcgatccgacgctgcgcgagcgcgtggtgcaggcgtggatggatgcgcaggcgtatgcgctgtcgacctacgcgaccgcgagccggctgctgaagggcggccatatcggcgcggagtcgagcaccaacaaggtgttctggtcggaactcgacctgcgcatgcaccagaccgcgctcgacattctcggcgcgcacggcgaggtcgtcccgcagacggccgcgcagcacgcgacgctcggtcactggctcgacggcttcctgttcgcgcaggccggcacgatctacgcgggcaccaacgagatccagcgcaacatcgtcgccgaacggatgctcggcatgccgcgcgcatgacggcgccggcgccaccccactgaacggacatcgtatggatttcgtattcgatgaagaccaggaagcgctcgcggacagcgtgaagcgcctgctgatgaccgagatgacgcccgagctgatccgcgagctctgggccacgccgaccgggcgttcggacgacctgtgggcgctgttcgcgtcgcaggggctgaccgccgtgtcggtgcccgaggcgcacggcggcctcggcctgagcgaagcggaatgggcgctgctcgcgcagacctacggttacttcggcagccccgagccgctgctcggcacggcgctcgtctcggccggcgtgctcgcgcggctgccggcgagcgactggcgcgacgcgctgctgcgcgacatcgccgaagggcgcgcgcgcgtcgcgctcgtgcatccggtgaacccgtatgcggccgacgtgcacgtcgcgcaagcgctcctttgcgagcaccgtggcgagctgcaccgcgtcgatcccgcgcagtgtgcgtggcgcgcggtggacagcgtcgacccgtcgcggcggctgttcacgctcgactgggagccgtcggcggctacgcgcatcgcaggcgccgacgaagccgcgccgctgctggaccgtgcgctcgaccacggcgcgttcgcggtcgccgcgcaactgctcggcctcacgcagcgcgtgctcgacgtcgcgatcgactacagcgcgcagcgcaagcagttcggcaaggcgatcgggtcgtaccaggcgctcaagcatctgcttgccgatgtcgcgatccgctacgagttcgcgcggccggtggtcgcgcgcgccgcgcaggcgatcgccgacgatcacccgcagcgcgcggtgttcgtgtcccacgcgaagctcgcggcgacgtcggccgcgcagctcgccgcgcgtcactcgatgcaggtgcacggggcgatcggctacacgtgggagctcgacctgcagatcttcatgaagcgcatctgggcgctctccggcgctggggcgacagcgcgttccacaaggcccgcgtggccgacgcgatcctcggcgacgcgttgccgatcggccccgcgcagaccttcgacctcgaggaaacccgtcaatgaaacaagcctatatcgtcgacgcgctgcgcacgccgaccggccgccgcaagggcgggctcgcgcacgtgcatgcggccgacctcggcggcttcgtgctgaagacgctcgtcgaacgcaatgcgattcccgccgacgaatacgacgacgtggtgttcggctgcgtcgacacgatcggcccgctcgcgggcaacatcgcgcgcacctgctggctcgcggccgggttgccgctgcaggtgccgggcgtgacggtcgaccgccagtgcggctcgtcgcagcaggccgtgcatttcgccgcacaggccgtgatgagcggcgtgcaggacgtggtggtcgcgggcggcgtgcagacgatgacgcagatcccgatttcgtcagcgatgacctgcgcggcgccgctcggcttcggcgacccgttctcgggcagcaccggctggcgcgcacgattcggcgacgcgccggtgtcgcagttcgtcgccgcgcagcggatcgccgatcactggaacctgtcgcgcgacgtgatggagcgctatgcgctcgaaagccaccgccgtgcggtcgccgcgatcgaggccgggcatttcaagcgggaaatcgtgccgctcgaaggcgtgctgcacgacgagacgccgcgccccgacacgtcgctggaaaagatggcgacgctcgagccgctgacaccgggcggctcgctgacggccaccgtcgcgagccagacctgcgacgcggccgcggcgctgctgatcgtgtcggaggacgcgttgaagcgctacggcttcacgccgcgcgcacgcatccatcacctgagcgtgctgggcgacgatccgctgtggatgctcaccgcgccgatcccggcgacgaaggccgcgttgaagaagagcgggctcgactggtcgcagatcgacgtcgtcgagatgaacgaggcgttcgcgtcggtcgcgcaggcgtggctggccgagacgcgtttcccgcatgaaaagaccaacccgaacggcggcggcatcgcgctcggccatccgctcggcgcgaccggtgcgcggctgatgacgacgctgctgcacgaactggaacgcaccggcggccggtacggattgcagacgatgtgcgaaggcggcggcctcgcgaacgtcacgatcatcgagcgcctgtgagcgcgtcactttcacgatctcacgatccaagaggcaccagcatgggaatctgtaacggacgcaccgtcatcatcaccggcgcgggcggcgggctcgggcgcgaatatgcgctcgcgttcgcggccgaaggcgcggcggtcgtcgtcaacgacatccggcacgaggccgcacaggccgtgtgcgacgagatcgcacgacgcggcggcagcgcgcttgcgaatgcggacgacatcacgcgcgtcgaaacggcgcagcggatcgtcgacgcggcccgcgaagcgttcggcgatgtgcacgtgctcgtcaacaacgcgggcatctgccgcgacaagatgttcacgagcatgaccgaaaccgactgggacgacgtgatgcgcgtgcacctgcgcggccacttctgcctgtcgagcgtgctggcgcgcgtgtggcgcgatgccgcgaaggccggtcacgcggtcgacgcgcggatcgtcaacacgagttccggcgccggcctgcaaggctcgatcggccagtcgaactacggcgcggcgaaggccggcatcgccgcgctcacgctgatgcaggcggccgagctgcagcgctacggcgtgcgcgtgaacgcactcgcgccggccgcacgcacgtcgatgaccgaaggcgtgttcgccgacatgatgaagaagcccgaggacggcggcttcgactatttcgacccggccaacgtcgcgccgctcgtcgtgtggctcggcagcgcgctgtcggccgacgtgacgggccgcgtgttcgaggtcgcaggcgggatgatcgcggtcgcggaaggctggcgcacgggcccgagcgtcgaccgcggcgcgcgctgggcggcggccgaggtcggcccggcggtcgcgcggctgctcgccgaggcgcggcccgcgcagcgcgtgtacgggagctgagcatggatctggcgctcaccgacgaacaggcgatgatccgcgacgcggcggccgacgtgctcgccgaacgcagcgcgtccgccgacgtgcgccgcgcactcgagcaatcggccggccgcgacgatgcgctgtgggccgcgctggcgggcgaactcggctggaacgcgcttgcgctgccggaggcggcgggcgggctcgggctcggcgcggtcgagcaggcggtgctgatggaacagcttggccggcgcatcgcgtgcgtgccgtatttttcgaccgcgtgcctggcggcgaccgcgctcgcgggctgcactgacaatccgctggcgatggactggctcgcgaagatcgccgaaggcgcatgcagcgcgacgctggcgctgccgttcgactggctattcggcgagccaggtggcgcacgggtcggccggccatatggccggccgggtgccaatgcgttcggcgcatcgttcgatgagtcgttcgacgaaccggccagtgcgcgaccgcttccgttcatcgcggaagaaaccgcggctggcttcgcattgtccggcgtcgcggcgcaagtgctcgacggtgcgcgcgccgacctgctgctggttccggcgcggatcgcgaacgaagggcagtcggtcggcctgttcgcgatcgacatgactgccggcgcagccggcgttgcggtgacgccgctcgacacgctcgacgcgacgaggccgctcgcacggattgcgctcgacgacgtgcgcgtgagccgcgacgcgctgattgcgggccgtgacgcggcgcaggtgctcgaacgcgccgcatggttcgcggcgctcgcgctggccgccgaacaactcggcggcgcacaacaatgcctcgacctgacgctcgactacacgagccagcgcgtgcagttcggccgcgcgatcgcgtcgttccaggccgtcaagcaccgttgcgcgcagatgatggtgttgatcgaatcggcgcgctcggccgtgctcggtgcggcacatgcatgggacgcggaggccggcagcgtggtgccgggcaacgcattgcgtgccgacattgccgcggcgaaatccgccgcgaacgacgcgtatgcgttctgcgcacaggaagcgatccagttgcacggcggcgtcggctttacgtgggaatacgacccgcatctctacttcaagcgcgcgcaggcgtcgggcgcgcagttcggcagcacgccgcaactgctcgaatggatcgcaggccatgcgatcgaaggcggcgacgcgcaccgcgacgacgcgtccgccgccgcggttgcggcgcccacccgcccgtccgccgcacgcgcaggagcccttcaatgaaccgcgaaacgcgcgaacagcaattgcggcacgaagtggccgactgggtgcaatcgcacctgaccggcgaattcgcgtgcctgaaataccgcggcggccccggcgacgaggaagcgtttcccgatctgcgcaaggcatgggagcgggaactggcgcggggcggctggaccggcctcggctggccgaccgccgccggcgggcgcggcttctcggtggccgaacaggtgatcttccacgaggaatacgcgcgcgccggaggccgggaaggatgggccacatcggcgaagggctgctcgggccgacgctcgtcgcatgcggcaccgacgatcagcgcgcgcgtttcctgcccggcattctcgccggcacgcagttctggtgccagggctattcggagccgggcgcgggttcggatctggcgaatgtccgcacgcgtgccgaacaggatgcggacggtacgtggcgcgtctacggccagaaggtctggacgtcgcttgcacacgattccgactggatcttcgtgctcgcacgcaccgatcccgcgtcgaagggcaacaaggggctgtcgttcctgctgatgccgctcgaccagcctggcatcgagatccggccgatcaggcagctcaacggcggcgcggaattcaacgaagtgttcttcgacggcgcgcgcgcggaagcacgcgacctcgtcggcgcgcccggcgacggctggcggatcgcgatgacgctgctcggtttcgaacgcgggatgtcgacgctcggccagcagatgcagttcgttcgcgagctcgaatgggtgatcgacgccgcgcgcgaatcgggcgcggaccgcgacccggtgctgcggcagcggatcggccgcgcgtgggccgggctgcgcgtgatgcgctacaacgcgctgcgcatgctgtccggtgccgacgacgccgatggcggtgccaccgcgccgctgcgccgcgaggcattgatctacaagtatttctggtcgaactggcaccgcgacctcggccagcttgcgatggatgcgctcgggtctcgcgcgaacgtgatcgatccggccgacgaaaagctcacccatctgcagcgcgtattcctgttctcccgtgcggacacgatctacgcgggtaccaacgaaatccagctcaacatcatggccgagcgcgggctcggcatgcccagggaaccacgaggcaccgcatgaccgaaccccagatccagaaagcgccggcctacgtgccgggccaccagctgctcgcaggcaaatcggtgctgatcacggccgccgccggcgccggcatcggcttcgcggccgcgcgccgctgcgcggaggaaggctgccgcgcgctgttcatctccgacatccacgaaaagcgcctcgaacaggccgtcgaaacgctgcgtgccgaaacggggctgcaacaggtctacggccgcctgtgcaacgtcgcggtcgaggccgacgtgcaggcactcgttgccgacgcgcgggacaagctcgacggcgtcgacgtgctgatcaacaacgcggggctcggcgggtcgacccgcatcgtcgatatggacgatgccgaatggtcgcgggtgatcgacattagcctcaccgggacgttccggatgacgcgcgcgatgctgccgcacatgcaggcccgcggccgcgcgcgatcgtcaacaacgcatcggtgctcggctggcgcgcgcaagcggaacaggcgcactacgcggccgcgaaggcgggcgtgatggcgctcacgcgctgcgcggcgctcgaggcgtcgccgtacggtgtgcgcatcaacgcggtcgcgccgagcatcgcgatgcacgattttctgaagaagtcggccccggccgacctgctgaatcaactggcgtcgcgcgaagctttcgggcgcgccgccgaagtctgggaggtcgcgaacgtgatggtgttccttgcaagcgattacgcgtcgtacatgacgggcgaagtgctgtcggtcagcagccagcacgcatgatgagcacgaccctcgaccccgtgcgcgcgacgccccgcgtgttcgcgcatcccggcgaactcgcggcggccgtcggcaacacgctcggcgcgagcgcgtggctcgcgatcgaccagatccgcatcgacggcttcgccgacgcgacgggcgatcaccagtgggtgcacgtcgacccggtgcgcgcgaaggacggcccgttcggcgcgtgcatcgcgcacggctacctgacgctgtcgctcgtcaatcatttcctgccgcagatcgtgcgtatcgacggcgtgcggctcggcgtcaactacggctgcgacaggatccgtttccccgcgccggtgaaggtcggcgcgcgcgtgcgcggcgtcggcgagctgctgcgcgtcgagccgctcgacggcggtgtgcaggcatggattcgcgtgaccgtcgagatcgaaggcgaagcgaaacccggctgcgtggccgacacgatcagccgttactacttctagattcagagagccagcccatggaagacgcagtcatcgtttccgtcgcacgcacgccgatcggcaaggcgtttcgcggcatgttcaacgacaccgaggcgcccgcgctgggcggccacgtggtgcgcaccgcgctcgaacgcgcaggcgtcgcgccggccgacgtcgacgacgtgctgatcggctgcgccgcgcagcagggcacgcagggctacaacatcggccgcctgtcggcggcggcggccgggctgccggcttcggtgcccggcatggcgatcgaccgcatgtgctcgtcgggcctgatgtcgatcgcgagcgccgcgcgcagcatcggcgcgggcgatgcgcggatcgtggtcgcgggcggcgtcgagtcgatctcgctcacgcagaacaagcacaagaacgcgtatcgcgcgcgttcgcaggccgtgctcgaccaccagccggccgcctacatggcgatgatggaaacggccgagatcgtgtcgcgccgctatggaatctcgcgtgcggcgcaggacgaattcgcgctgcagagccaccagcgcacggccgacgcccaggcggccggccgcttcgatgcggaaatcgcgccgctcgacgtgcggcgcgcgctgttcgacaaggaaggcaacccggccggccacgaggatctgcgtgcggcgcgcgacgaaggcgtgcgcgccgacacgacggccgaacggctcgcggggctgaagccgtcgtggagcggcggcaaggtcgtcgagcagggcgagttcgtgacggccggcaatgcgtcgcaactgtcggacggcgcggcggccgtggtcgtgatgtcgcgcagcgaggcgctacgccgcgggctgacgctgctcggcgcgttccgcggcctcgcggtggccggctgcgagcccgacgagatgggcatcggcccggtgttcgcgattccgaagctgctggcgcgcttcggcatgaccgtcggcgacatcgggctgtgggagctgaacgaggcgttcgcgtgccaggcgctgtactgccgcgacacgctcggcattcccgacgccaggctgaacgtcgacggcggtgcgatcgcgctcggccatccgttcgggatgtcgggtacgcggatgacgatgcacgcactgctcgaaggcgcgcggcgcggcgtacggcacgcggtcgtgacgatgtgcatcggcggcgggatgggtgccgccgcgctgttcgaggtcggcgcatagggcacgtcgcggacgtagcggcacgcggatgggccgcgccgcacacgcggcgaaccattcacgaacgacgattcgaggccgcggccatgaccggcggcccgtcgacttgcaggcgacggtcgtcggcgcgcacgcgccaacggccgtcgaacgcagaaacaggagacaagccatgaaacgaaccttgcccggactcgcgatgtcggcgctcgtgctcggcgccgcgctgttcgcgttttcccgcgcccgctgccggcgttcccggtcaccgcgatccatgcggaccggctgcagatcaacgggctcgcccgggccggcgcgcgcatcgtcgcggtcggcgaacgcggcgtgatcctgctgagcgacgattcgggcgcccgctggcggccggcgtctgtcacgcccgaccaggcatcgacgctcacgcaggtgcgtttcatcacaccgacgctcgggatcgcggtcggccacgacggccggatcgtgcgcagcgacgacgccggcatgcactggcatgaagtgcacatcgaccatgagcattccgatccgctgctgtccgtgtggggtgcggcgggcggcccgctgttcgcggccggcagcttcggccagctgctgcgctcggacgacgcgggcctcacgtggcagccgctgaagacgccggccggcgaccgtcacctcaacgcgatcgtcggcgacggccacggcaacctgctggtcgcgggcgagagcggcacgctgctgcgctcgaccgacaacggcgcgacgtgggacaagctgccgtcgccgtacgccggttcgctgttcggcgcgctgatgctcgcgaacggcgactgggtcgcatacgggatgcgcggcaacgtggtgcgcagcaccgatcgcggcgcgacctggacgcatgtggacagccacgtgccggtgtcgtacttcggcgcgacccagctcaccggcggcgaactcgtgctggtggggcagggcggcgcgatcgtcgcatcgcgcgacggcgggctgaccttcgacgtgcgcaagctcggcggcgtgcagagcctcgcggccgtgctcgacatgggccacggcgcgctgctgctcggcggcgaggccggcgtcgcgccgctggccggcgcgctggcgtcgacgccgtcgccgtcctgacgccggccgcccgcagcgccgccttccgttcgtttcgcatcgtccgtcccgacccgagaattccatgaacgacctgtcacgtcctcctgaagccgtttccgcgtcgcgtcttgccgcgttcgtcgagcgctgcgccgacacgatcatccgccggcgcaagctgctgatgctgctgtgcgtcgcggtgacgctcgcgctcggcttgtcggccacgcgcctgaagctcgatccgggcttcaacaagatgatcccgatgcagcacccgtacatgcaggtgttcgagcgctatgcgggtgcgttccccggcgcgaacacgatcctcgtgagcctgcgctggaagggcgacggcgacatctacaaccagacgttcatggacgcgctgcgccacgcgaccgacgacgtcttcttcatccccggcgtgaaccgctcgcgcgtgttctcgctgttcacgccgaacgtccactacacggaagtgaccgaggccggctttcgcggcgacgtggtcgtgcccggccagttctcgagcgcgaacccggacgatctcgcgaaggtgcgccgcaacgtcgcgcgttccgggcagatcggccgcctcgtcggcaacgacctgaaatcggcgctgatccgcgcggaactgcgcgagaccgacccggccaccggcaagcggctcgactacagcgcggtcgcgcgccagctcgaggaaatccgcgcgcgttatgcgaagcagggcatcgacgtgaacatcatcggcttcgcgaagctggtgggcgacgtcgagagcggcatcgcgggcgtgatggcgttcttcgcgctcgcgttcctcgtgacggccgcgctgctgtttgcctacacgcgctcgctgaagaccaccgtgctggcgctcgtcgtcgcactgctgccggtcgtgtggctgctcggcgcgctgccgctgctcgggctcggcatcgacccgatgtcgatcctcgtgccgttcctgatcttctcgatcggcgtgtcgcacgcggtgcagatgaccaacgcatggaagcaggcgctggtgcgcggcgcgtcgcccgtcgacgccgcgcgcgacgcgttccgcaagctgttcgtgccgggcacggtcgcgctgctgaccaacgcgctcggcttcatggtcatcatgcggatcaggatcgacatcgtgcgcgagctcggcattaccgcgtgcctcggcgtgctgctgatgatcgtcaccaacaaggtgttcctgccgatcctgctgtcgtacacgcgcctcgaacgcggcacgctggcgcgcgcgcagcgcacggcggcggccggcggcagcgggcggtggtcgcgcttcgcggtgttcgcgcggccggcgcccgcgctcggcgtgttcgcggtggcgctggcgctgctcgcgtacggcacgctcgaatcgcgcaagctggagatcggcgacatcggcaccggcgcgccggagctgcgcgcgaactcgcgctacaacatcgacaacgcggcgatcacgcaccagtacaacatcggcgtggacgtgctgtcggtgatcgtcgagacgaccggcttcgacgacgcgtgcctgcattacccggtgatgagcgcgatcgagcggttcgagatgaacatgcgcggcgtggccggcgtgcagtcggtgacgagcgtgtcgtcgcagggcaaggtgttcatcgccgcattcaacgagggcaacccgcgctgggccgcgctgccgcgctcgagcgacgggctcacgcaaggctccaacgcgttcgaccccgacaacgggatgaacaccgcgaactgcaaggcgatccaggtcctgatctacacgaagaaccacgaaggcacgaccatcgcgcacatcgtcgacgagatcaggcgtttcgcggccgagaacccgacgccgaacgtcgcgttccggctcgcgggcggcaacgtcggcgtgatggcggcgaccaacgaggcggtcggcgacgcggagatcgcgatgctgctgtcgatcttcggcgcgatcgcgctgctctgcgcggtcacgttccgctcgtggcgcgcggtgctgtgcatcgtcgtgccgctcacgctcgtgtcgatcctgtgcaacgcggtgatggcgcgtctcggcatcgggctgaaggtcgcgacgctgccggtgatcacgctcggcgtgggcgtgggcgtcgactacgggatctacctgtacgaacgcctgcagcacgacctccgccacggcgcgacgctgccggacgccttcgccgacgcgatgcgccagcgcggcacggccgcgctgttcacggccgtcacgatgttcatcggcgtcggcacgtgggcgttttccgcgctgaagttccaggtcgacatgggcgtgctgctcgcgttcatgttcctcgtgaacctgttcggcgccgtgttcctgctgcccgcgctcgccgcgtggctcggcgtcgagcgtgccgagcgccgcgtgcagcaggcgcacgcgcagccgtcgccggcggctccggcaacgctgaaaccgtcgcccgcgctcgaacccggcaacccggtgcgctgaccggcgcccccatttccccgcgcgcggccggccgccgcgcgttgtccacaagaggagtcaacccgcatgtccgcacgcccttacaagatcgaagcccagccgctcgcgcagcgctatgcgcgcggctggcactgcctcgggctcgcccgcgactacaaggacggcaagccgcacacgctgaacgccttcggccgcaagctcgccgtgttcgccgattcgaccggcaaggtcaacgtcgtcgacgcgtactgcccgcacatgggcgccgacctgagcctcggcacggtgcagggcgacaacctcgtgtgcccgttccacggctgggcgtggagcggcgaagggcagtgcgcatcgattccgtactgcaagcggatcccgccgaaggcgcgcatcggcgcatggccgacctgcgaggaaaacaacctgctgttcgtctggaacgacccggaaggcaacgcaccgccgcccgaagtcgcgattccgcgcctcgacgtgtgcttctccgacgaatggtcggactgggtcgtcgacaagatggtgatccaggccaactgccgcgagctggtcgacaacatctcggacgtcgcgcacttcgcgaccgtgcaccgcgcgccgatcgactatttcgcgaacctgttcgaggatcacaaggcgacgcagctgatggtcggccgcagcgagaagctcggcggcgacgccctgaccgcgctgtcgacgtatttcgggcccgccgtgcacatcacgcagatgacggggcagagcggcgggcagccgatccactcggtgctgctgaactgccacgtgccgatcgatatgaacagcttcgagctgcgctacggcgtgatcgtgaagaaggtggccgggctgtccgacgagcagaacacggagatcgcgaatgcgtacgtgaaggaagcgcagcgcgcgttctacgaggacgtcgacatctggcacagcaagacgcggatcgacaacccgctgctgtgcgagggcgacgggccgctgtaccagatgcgcgactggtattcgcagttctacctggacgtggcggacgtgcggccgacgagcgtcgcgcgcaaggcgttcgagatgcggattcgcgaaggcgatgcgccgccggcgctgcatcacgtgttcgagccgcggtaagaaccggcgggccgcccgccggccggaaagcgggggcgcatcgaaatgcgtcccgtcggccggcaacacccgccgcgcaaggcgctcgcggcgggtgtgcttgtgcgccgcatcaaaatgtcttgacgaaacggccgctaccgcgtagtgtccatggccgaagtgttcaagaagttcgattgctcatcattggccgcactccgtgcggcagtcgttggtctctcctcttttgagtctttctgtgcccgttgcgggcgcatgttcaattattcgtattaaggaagtatttgtggataccggtaccgtcaagtggttcaacgaaaccaagggctttggtttcatctcccggacaacggcggcgacgatctgttcgcccatttctctgaaattcgcggcacgggcttcaagaccctggccgaaggccagaaggtcagcttcgaagtgaagcgcggcccgaagggtctgcaagcgtcgaacatcacgccgcagtaagccgcatcggcagcggccgccaaacggtggccgccgtcggacggattggcgcgcacggcgccgcttcggcggcagccggcgcgtttccgatgcgcacgaccgatgcatcgcgacattcacgatgcatcggtcgtgtcgcctccctcatcgcatgcctgtatggcgtgcgacgcaacgccctcgcgaagcgcccgccgcttcgccagcgcatcaccgcttcaacgcatcaacccgagcagaccgccgccatgccttgccggcgcggtcccgacttgcgcggcgctttatgcgccgccgccaccgaccgcctgaacgccgcaacgcgccgggctccgatcgcaagacaggcccacggcccgtctgaacgaaccgatccccggcagcctgccggccgccgtcccgttgcgggacacggcgccgggcagatcgccgcggctgcggtcaattaccttgtctggaggaattggtttggcaaaagaagaactgctggaactggacggaatcgtcgacgaagtgctgccggacagcaaataccgtgtcacgctggaaaacggcgtcgtggtgggcgcgtacgcgtcgggccgcatgcgcaagaaccacatccgcattctcgcgggcgaccgcgtgacgctggaactgtcggtctatgacctcaccaagggccgcatcaacttccggcacaaggacgcgaattcgccgcgtccgcagcgcaccggcgggccgcgtcgttaagcggcaacgatcgggcgcgcagccgcgtgccgatcgaatcccgtccggcccgcgcggccggacgaaccggatggacggcacatgacgtgccgctcacccgtcgccggcggcgtcgccatgccgcgccggccaaccccgccgtcaccggccgccgcgcgtgcgcaaacgctcaggcagccgcgtcccgcaggaaatcctcgatgaccatcgcgaaatacggcgggcactcctgcatcgggtaatgcccgcaattcggtatcgtcgcgagccgcgcgttcgggtgccacgcgaggaacgtcgcctgcatcgccgcttcgtcgagccccggatccttgtcgccgacgatcaccaggaagcgcgtctcgagcccgcggatatcgtcgacgaaatccgttccggtcagcatgtcgagatacgcgagccggcaggccggcgccacgcgctcgcggttctgccgcagcttcaggtcggcccagcgcgccgacaatccacccgtcacgaatcgcatgagccggcgaaacgcatcgtcattgacggccgtgctcgcgaagaacgcgcgtgcgtcgtcgttcaggcggttgccggcggccgacaccgggcacacggcgatcgcgctcttgatgcgggagggcgcatcggcggcgagccgttgtgtcgccatgcccgtcatcgaatggccgatcacgtgaaagcgcggccagccgagacggtccgcgagcgcgaggcagtcggccgagatctcgtcgacggtacaggtgccgcgcaggtggatggattcgccgtagccgcgcaggtcgacgaacacgtacgtgaatgccgattcgtcgagatacgggagcagcgccgcgtagttcgtatggtcgccgagccagtcgtgcaggaccatcacgcattcggggccggtaccgtgccgcaggtagccgaggccgtcgtggtcggcgttcggtccggaggagagggcgtcgatacggttcatttcaaggggtttcctttggtgggtgaaccaaaacgaaacgccctcccggcggaccgggagggcgtcttgaaagtgcatcgatcgtatcgggccaaccggcgaaagtcaacgttcgacgtgccatcccgcccgacacgtcgatgcggcgcgcattgaccggcggttgtcgtccgacagccgcaacgcgatcgtcagaccgatgtcgtgacgcggaaagccgcgccggccggcggctgaccgcacgcgcggcgacgccgttcgcgtgcggctttacgtgcgggccggcgcggtcgtacactcgtcggcaattcgcggcccgcgccgcgcgtgcggctttcaattccttcagcgtctttcagcgggccaacggccgtgccagccggactttcgtcgcgcgacgccaggaggcgccatgagtgcagacgcagccccgcatccccgtcggttcaggaccgcatccggcacgtgttcgtgctgatgctcgagaaccgctccttcgaccacctgttcgcgctgtcgggctaccccggcatcgtcgccgcgtcgccgggcaacagcaacgcgtatggcggcgcggtctatccgttcggcggcggcgcgcccgaccggatgccgaccgatccgtgccacgaattcaccgacgtgctcgagcagctctgcggcgcgggcgtgccgttcgtgaaagggcaggcctatccgccggtccgcaataccggattcgtgtcgaactacgcgacgtcgcgttccgaaggcaagccgccgcagccggccgacgcgggcaagatcatgcagggcgtcgacatcgcgacgcaggcgccgtcgctgcacgcgctcgcgaacgcgttcgtgctgtgcgacgcgtggcacgcatcgatgccggggccgacctggccgaatcgcttttcctgcacggtgcgtcgtcggccgggctcgaccattcgccgaccagggaggaaatggccgggtgggacgcattcgacggttttccgtatccgaagggttcgatcttcgccgcgctcggcgacgacaactggcgcatctaccaggaccagacgggcaatccggtcggccacgtgccgcaggtcgcgtcgctgaagggcatcagcttcttcgacatcgacgacctcgcgcatttcgaggccgatctcgcggcgggccatacggcgcgctatacgttcatcgagcccggttacggcgacatcgtgcacggcacctaccagaacggcagctcgcagcatccgatggacggcctcgcaggcggcgaccagctcgtcgcgcgcgtgtacaacgcgatccgcaattcgccggtgtggaacagcagcctgctcgtgatctgctacgacgagcacggcggcttctacgattcggtcgggccgggcgctgcgccgccgccgaacgatggcgcggcggcgacgctgaacgcgagcggcttcgggttcgacgtgtacggcgtgcgggtgccggcgatcgtgatttcgccgtgggtcgcggccgggcaggtcgaccatacggtgtacgaccatgcgtcggtcgccgcgacgctcgagcggctgttcggcctggcgccgctgaccgaccgcgaccgtctcgcgaacgacctgctggggctcgtgacgactacgtgccggacggattgtccgcaaaggatcggaacatgagtacgacaccagacccgcgcgatgcgctgcccgtgcgcgacggcacgagcctgatcgcatacctgcacatcctgaagaaagcgcatgcggcgctggtcggccatgacaaggcccatcggcgcttcagcgagatcgtgacgcgagggcaggcgcggcaatacatcgaggaactgatgccgtcgctgctgcaggcgcgcgaagcgcatcggcagcgcaggcacggtgggaagcatcgttgatgcggcgagcggcaccgataccgaaggcgcgagcgcgcacagcagcgatgcgacggtgaaggagccgtgcccgcgatgaagatgcggcgccggccgcgcaaatcggcgggcagccggcccgtcggcagcagaagcgaggttgccgcgccgccgacgccccgttgcactgcgccgacgcccgcgttcgcttacgccgccacctcccgcgcccgcaccatcgtcagcgccgcatcctcgatcatgtcctcctgcccgccgacgagccgctgccggcccagttcgacgaggatgtcgcgcgcgggaatcccgtacttcgcttccgcgcgcttcgcgaacagcaggaacgacgagtagacgcccgcatagccgagcgtcagcgcgtcgcggtcgaggcggatcggcgaatccatgatcggcacgacgagatcctcggcgacgtccgagatcgcgaacacgtcgacgcccgtctctattcccatccggtcgcataccgcgacgaacacttccatcggcgtgttgcccgcgccggcgccgaggccggccgcggccgcatcgatccggttcgcaccggccgccacggccgcgaccgagttcgcgacacccatcgcgaggttgtgatggccgtggaagccgagctccgtctccggcttcagcgcgtcgcgcacctggccgatccgcgcggtcacgtcgtcgggcagcatgtggccggccgaatcggtgatgtagatgcagttcgcgccatacgattccatcagcttcgcctgcacgacgagctgcgccggcgacgacatgtgcgccatcatcaggaatccgaccgtatcgaggccgagcgtgcgcgcgaggccgatgtgctgttccgatacgtccgcttcggtgcagtgcgtcgcgacgcgaatcgtgccgacgccgagttcgtgcgccatgcgcagatgctcgacggtaccgatgccgggcagcagcagcgccgacaccttcgcctgcttcagctccgggatcacggcgcccaggtacgcctcgtcggtgtgcgcgggaaaccgtagttgaccgaggcgccgccgagcccgtcgccgtgcgtgacctcgatcagcggcacgccggccgcgtcgagcccgcgcgcgatgttgcgcatctggtcgagcgtgatctggtggcgcttcgggtgcatgccgtcgcgcaacgacatgtcgtggacggtgatcttcttgcctgcaagtgacatcgtgtgactcctcgactcaagcggtggcggccgtcgcggccagcatctgttcggcgaaacgctcggccgtggcggccgcggcggcggtcatgatgtcgaggttgcccgcgtacttcggcaggtagtcgccgagcccttcgacctccatgaacaccgatacgcgattgccgtcgaacaccgggccgttcttcagcgtatagccgggcacgtagcgttgcacttccttgaccatcgcatgcacggacgcggtgatcgcgtcgacgtcgggcgggccgtcggtcaggcagtggatcgtgtcgcgcatgatcagcggcggctcggccgggttgatcacgatgatcgccttgcccttgcgtgcgccgccgacctgttcgatcgcgccggacgtcgtgcgcgtgaattcgtcgatgttcttgcgcgtgccggggccgaccgagcgcgacgataccgttgcaacgatctcgccgtacgcgaccggctgaacgcgcgacaccgcgtacaccatcgggatcgtcgcctggccgccgcaggtcaccatgttcacgttcgcctgcgcgctgtcgagatgcgcgtcgaggttcaccggcggcacgcagtacggcccgatcgcggcgggcgtcaggtcgatcatcttcacgccgagcgcggtgagcttgtcggagttgtcacggtgcacgtaggccgacgtcgcgtcgaacgcgatgcggatgtcgtcggcggcgacgtgcggcagcagcccgtcgacgcccttgtcggtggtcttcaggccgaactcgcgggcgcgcgcgaggccgtcggaggccggatcgatgccgaccatccacacgggttcgagcaccggcgagcggcgcagcttgaccagcaggtcggtgccgatgttgcccggcccgatcagtgcgcatttgattttcttcatcaggattgttcctttagataaagcggacgtcgcaactgccgatgccggagatatgcatcgacagtgcgtcgccggccgtgaccggaatcagtttcgcgagcgagccggacagcacgatctcgccggcaagcagtggcacgtcgtacgcggcgagcgtgttcgcgagccacgcgaccgcgtcggcgggatggccgagcgccgcgtcgccgcggccttgcgcgacgggctcgccgttcttctcgatcgtcatctcgcacgcggcgagatcgagcgtgcgcgggtcgacgcgcgtttcgccgagcacgtacacgccgcacgacgcgttgtcggcgacggtgtcctcgatgcggatcgcccagtcgcggatgcgcgagtcgacgatctcgaagcagggcgcgacggcggccgtcgcggcgatcacgtcggtgcggtcgatgccggggccgcgcaggtcgtgcgacaggatgaacgcgatctcgccctcggcgcgcggcgcgatcagcgaatcggcggcgatcgcttcgccggccgcgtagtgcatgcccgacagcaggatgccgaaatcgggctggcgcacgttcagcatgtcctgcacggcctggctcgtcacgccgatcttcttgccgacgaccgcttcgccgtgttcgacgcggcgttcgatgaagcgctgctggatgcggtacgcgtcgtcgagcgacaggcggcgcgcacggcccgacagcggcgcgaccggtgtgcgcgcgtgccatgcggcgtacagctcgtcgccgagcgtcgtatgcaggcgggaagacatgaaagggccctcgaatggaaatggccgccgtcacgggcggcgtcgtgcgccggagcgggctccggcgcgtgggtcgcgggcatgccgcgtcggtcggtcgatcagttgcccgaactgcggatcgcgtcgggcgagaaatacgcctcgttgaactgcgggctgttgtcgagcttcggcatcgggccttcgttcgtcaggcggtcggccatgtacgcgccggagatcaggtcgtggaagaacaccgcgctcgggtagaacaccttcgcgtcgtaggcgtacagcgacgtcgcgacgttggtacgccacagctggccgcgcgcgtcgtagttgtccgcgagcagcgattgccacgaatcctcatcgatgtacagcacgcgcttcgcgtactggtgacggtagccgctcttcagcgtggcctgcagcacccacacgcgatgcagttcgtagcggatgtagctcgggttctcgtggcccttggtcagcagttcgccgtacttcaccgcgctgtccatcaccttgtagttgttgtacggcacgtagatctcgcgcttgccgacgatcttccagtcgtagcgatcgccggggccgttgtacaggcggtcgtcgtcgaccgtgcggaagccgcccgggccctgcggctggtcgtagccgtattcaggcgcctggcgcacgcgccgcgtgccggggttgtacatccacgtgcgcgacgagttgtccgcgccggccttgtcccagttcgtgaagccgacgatcagcgagccgcggtcggacagcggcagctccgtcgcgttgcggtagtacgtgcggttgttcaggtcgctcttcacgtcgtacttgccgacgttgcgcggcgagtagatgtcgtagcgcaccttgccccacgcgatgttgccgtcggagtagacgaccgcctggtcgtaggtggcctgctcggtgccgatcgacgacgagaagcgctggttccacagcaattcggcggcggtcttcgggatcggatagggcaccgtcggcggcgcgttcgtgaggccgttcgcgtcggacgtcatcgtcgaatccggcgcgtacgtgcgaatgtccttgtagacggaatccggatagcggaagtctcggtgggtcgggtagacgatgatcttgaacgtggccggatagcgcttgaacatcgccttctggccgtcggtcaggtgctccgcgtactgcgccatgttttccgcggtgatcgtcgcgaccggcttctcgctcgcgtacggatcggggtaacggctgccgcgcttgtactgcacgtccggcggcgtgccgagccacttgcccgaccactcgggcacgccgttgtccttgctcgcggcgcgcacggcgcccatcggggtcaactggccgtcgagcgccttcaggtcgtccggcgtgaccttcgggtacgacgccgtcgcggcgagtgcgcacgcggcgatcaccgacgcgcgcaggaggggagacgaattcgcttcatgacaaatcctcttgctgagtgacgagcggccgggccgctcagaagtggtaggtcgccgtggccagcacgtagtcgcgatccgcgagcgggcgcgtgaccgggttcggcgagccgaggaacttcgcatagacgagcgacagctgcaggttgctcaggcgcgtgaacgtcacgccggccgtcacgcggtggtcgccctggcccgtcagcgagccgagcgcgccggcgagcggcgacgtgcccgtcaggtcgtgcgtgtaggtcagcggcacgtcgagatcccagccgttgaacacgttcttgtagctgagcgtccacgcgatctccatcgcgagcgcgttgcgcgagttggcgagcgtggtcgacccgtcgagctcggagatgctgcccgcatgcacgtacgtcagttcgccgatcagcgactgcgaattcgcgaggaagctcggcccgatcgagtagatgccggacaggttggtctgcagcacgttcgcgcgggtcgactgcgggcccgtcggcgtattgacgagcaccgccgcgccctggcggtacgacacttcgcccgcgacgttcaccgggccgacctgcgtcgagaagctcgcgccggtcagcttgatgttgctgaagtaggtctgctggtactggagcgtcgggaagtacgtggtgacgacactcgggttcatgtcgttgtagtgcaggtggtacaggcccagctcggtgtcgccgagcacgcgaaagcgcgcgccgatccccactggttacgtgcgctcggcttgtcgtcggggccgcgcggaatgatcatcccgcccgggccgatgatgaactgcgcgcccgggccagttacgtcggagtagctccagtacgtgccgggcgcggtcagccggttctgctggtacgagaactggtagtagccgagcaggctgaagttcggcgtgatctgccactgcgtcgagatctgcggcaccggcagcaggatgtccttcacctcggcgccggccatgtacgacttggtcgcgtcggacggcccctgtgcacccgcgatgttcgggaagaacaggctttcgccccacgcgaccacttgatcgccgaccttcacgttcaggctcgtcgaaccgatgtggaacgtgttgtatgcatacgcggcgagcagcgtcgtgtggccgcccgaccagtagcgcgcgtcgctcgtgaaattgttgtactggcccgactggttcacggtgcccggcgcgtcgttgtagttcgggcggcgataggcctggtcgtagaacgtgtcggcacgcacgaacacaccccagtcgtcgtgcttcaggttcacttcgccgagcaggctgacctggttctcgatcagcttgttctttgcgaagttgcggtcgccgtcgtcgccgttgatgttcgccggcgtgaggagattgccgctcggtgcgcgggtgcgcatgccgaggccgtaactgagcgtgaacgtgtagtccagcgtcgtgtcggcgcccagctcgatcgtgctgccggcgtgcgcgccgggaacggcgcacgtcagcagcgcggcggccagcgtcgacagcgtggcggtggcccgcttgtcggtacggcgcgaaatccgttgatgcatggtgtctcctcttgggggtatcgacgacggtcgactatgtgttgtcgtgagaggcagagtagggagatcgcggtagcagggaatcgtcaaaatgaactagatgacttccctaggactggcaacgatcgcgcgacgccgcgtgcgcgacgcgtgtcatcgcgcgttcgcctgtgccgccgacaggaacgcaggtcgttcgccgccgccgtcgagccgcaggttcgcgcccgacgtgtacgacgcgtcggacgacgcaagaaagaggcacgcggaggcaacgtcgtcgggtgtcgcgaggcggccggcgggaatcgtcgcgcggatcgcgtcgagcgcatcgtcgtcgccgtagtggccttcggtggccgattccgtctgcacgaggctcgggctgatcgcgcacacgcgcacccgcggcgcccactcgaccgcgagcgacgtaaccgcattgacgaggcccgctttcgcggcgccgtacgcggccgtgccgggcgacggccgcgacgcgctgacgctcgcgatgaacagcatcacgccgcctttgggctgcggctgcatgatcgcgttcacgcgctgcgcgagctgcagcggcgcgatcaggttcagccgcacgatcgattcggtgaagcgcggcgacgcatcggccgcaagcgcgaacggcgagccgcccgcgttgctgacgagcacgtcgaggccgccggcctccgcgcggagggttgcgagcatcgcgtcgacctgttcgatgtcacgcaggtcggccgcgacgaatgccgcctcgcggccgccggccgcgggcggcgtgtcgggcgcgctgcgtccgcagacgaacacgcgcgcacccgccgcgagaaaccgttcggcgatgcgccgcccgatgcctttggtgccgcccgtcacgagcaccgtcttgccgctgtagtcgaatccgttcatcgtctgcctccgtttcggtgggccgatgataggaagaagcgcgcgcggcttcgtagtctgaaaggatgatgccggccggcgccggcgacgcaatcatcgtggtcaggcatccatcgaacgacgaaggagacaacccgcgatgacgatccccacgacgccgccggccggcatcttcaccgacgtgccgggcggcctgcgcctgcaccactacgaggcgggcgaaggccggcccgtggtgttcatccacggcagcggcccgggcgccagcggtttcagcaacttcaagcacaacgtgcccgcgtttgcggcggccggccatcgcgcgatcgtcgtcgacctgcccggctacgggcagtcgtcgaagccgtccgacgtcgcctatacgctcgatttcttcgtcggcgcgctgcatgcgcaactggacgcgctcgggatcgggccggccgtgctgctcggcaattcgctcggcggcgcgatcgcgctcaagtacgcgctcgactacccggacgaagtcgacggattgatcatgatggcaccgggcggcgtcgaggatcgcgacacctatttccggatggaaggcatccagcggatggtgaagctgttcaccaatcgccagatgaatgacgacacgatgcgcgagctgctgacgctgctcgtgcacgatccggcgatcgtcaccgacgcgctcgtggccgagcggatgaaggtgtgcgtcgagcagccgaccgaagtgctctcgacgatgagcgtgccgaacctgaccggcgcgctcggcgacctgcgctgcccggtgctgggtttctggggaacggacgaccgtttcaatccggtcggcggcgcgctgaagttcctcgaacgctgccgcgacgcgcgtttcgtgctgatgaaccggtgcggccactgggtgatggtggaacacgccgactatttcaatcgggaatgcctcgattttcttgcggcgcggaatacgcgataacgccggatgcccgcgagggcctgccccgatgcgggcgggccgtctgatcacatacaaggagacgacatgaagctcatcgaagacctgttcgacctgcgcggcaaggtggccgcgatcaccggcggcgcgcgcggcatcggcgcggagacggcgcgcacgctggccgcggccggtgcgagcgtcgcgattctcgacgtgctgtcgcaaccggcggaagcgctcgtcgaggagatccgcgcgcagggcggccaggccgcgttctggtcgctcgacgtgacgcaggaagccgacgtggcacgcgtgttcggcgagatcgtcgcgcgcttcgggcgcctcgacgtgctcgtgaacaacgcgggcatcgaaggccacaacgtgccgacgcacgagctcacgctcgcgcagtggcagcgcgtgcaggacgtgaacgtgaacggcgtgttcctgtgcacgcgtgccgcgattccgcatatcgacgcggccggcggcggctcgatcgtgaacctgtcgtcgatgtacgggatcgtcggcggccccgacgtgcccgcgtatcacgcgtcgaaggccgcggtgcggatgatggcgaaggtcgacgcgatgctgtacgcggcgaagaacatccgcgcgaactcggtacaccccggctatatccgtacgccgatgctcgaggaagcgttccgccagatggggcaggatcccgacaacgtgttcggctacctgcagacgcacgtgccgatggcgaagatcggcagcccgcgcgacatcgcggccggcatcctgtatctcgtgtcgccggccggccgttatgtgacgggcgcggagctcgtgatcgacggcggttataccgcgcgctgacgcggcgatcgcaccacaagggagacgtgcagttgaaagtgctcgtggcagtgaaacgcgtggtcgacgcgaacgtgaaggtcggcgtgaaatcagaccggacgggcgtcgacatcgcgaacgtgaagatgtcgatgaacccgttcgacgagattgcggtggaggaggccgtgcggttgaaggaggccggtgtcgtgaccgaagtgatagccgtgtcggtcggcgtcgcgcaggcgcaggaaacgctgcgcacggcgctcgcgatcggtgcggatcgcgcgatcctcgtcgaatcgaacgacagtgttgaaccgctgggcgtcgcgaaggtgttgaaggcgctggtcgacaaggaacagccgtcgctcgtgatcctcggcaagcaggcgatcgacgacgattcgaaccagaccgggcagatgctggccgcgctggcaggtttgccacaggcgacgtttgcatcgaaggtgagggtggccgacgggcgtgcgacggttgcgcgcgaagtcgacggcggcgcggaaacgctgtcgcttcaactgccggccgtggtgaccaccgacctgcgtttgaacgagccgcgctacgtgaccttgccgaacatcatgaaggcgaagaagaagccgctcgagatcgtgcagcccggcgaccttggcgtggatgtgacgccgcgtttgaaagtgctcaacgtgaacgagccgccgaagcgcgcagccggcatgaaggtgccggacgtgcagacgctggtcgcgaagctgaagaccgaagccagggtgctgtaacagggaacgcaacgaaatgacgattctggtaattgcggaacacgacaacgcatcgatcagggccgcgacactcaatgcggtggcggctgcgcaggcgctcggtgcggcaggcggcggtgacgtgcatgttctggtcgcgggccacaacgcgcaagcggcggccaaagcggcagcgaagatcgcgggggtatcgaaggtgctgctggccgatgcgccgcaactcgaagcgggcctcgcggaaaacgtcgaagcgaccgcgctgaacatcgcgaaggactattcgcacatcctcgcgcctgcgactgcatacggcaagaacatcgcgccgcgtatcgccgcgaagctggacgtcgcgcagatctccgagatcacggcggtcgtgtcggccgacacgttcgagcgcccgatctacgcgggcaacgcgattgcgacggtgcagtcgagcgacccgatcaaggtcatcacggtgcgtgcgacgggtttcgatccggtggcagcggaaggcggtagcgcgtcggtcgagaagatcgaagcagcggcagacactggcaagtcgcagttcgtgagccgtgaagtgacgaagctggaccgtccggagctcaccagcgcgaagatcatcgtgtcgggcggccgcggtctgggcagcggcgagaactatacgaaggtgctggagccactggccgacaagttgagcgcggcactcggcgcatcgcgcgcggcagtcgacgccggctacgtgccgaacgactaccaggtcggccagaccggcaagatcgtcgcaccgcagctgtacatcgcggtgggcatctcaggtgcgatccagcatctggccggcatgaaggattcgaaggtgatcgtcgcgatcaacaaggacccggaagcgccgatcttcagcgtggccgactacggcgtggtcggcgacctgttcacgctcgtgccggaagcggtcgcggcgctctgacgatgccgctgttcgaattcaacggaatgcggccgcgcgtcgatccgtccgcgtatgtcgacccgagcgcggtcgtgatcggcgacgtgacgatcggcgcacgctgctacatcggtccgcatgcgagcctgcgcggcgacttcggcgcgatcgtcgtcgaagacggcagcaacgtgcaggatggctgcgtgctgcacgtcgggatcggcgagacgtgtcggctcggcgtcaacagccacatcggccacggtgcgatcgtgcatggcgcgacgctcgaacccgacacgatgatcggaatgaatgcggtcgtgatggacggcgcgaccatcggcgccacgacgatcgtcgccgcgtgcgcattcgtgaaggccggctacgacgtgccgcgcggcgtgctgctcgcgggcatgccggggcgcgtcgtgcgtcggctgagcgacgcggagatcgacgcgaaggcgaacggcacgcggatttatcagcagctggcggcggattgcctgaggacgatcaggcggatcgacgcgtgagcgaagggcatccgggggcaggatgcgacggattgccgggcaggttgccgttgccgtaagatcggcactggctttccaccggcattcgcgtcacatgaaaaagaacgtccgtttgcggctcacggtcatcgcgtcggcttttgctgtctacagcgtttatatgcacatccagcagttcatcagcggctgcgtgtgggtcagggccatcagcgctgcagcttcgaaaacagcgcgaatttcgaaggctggatggatctcgacctgatgatcgcctgttgctgggtcgccgcggcggtggtgggctggatttccgtcgtgcaggccacgaagaagccgggttaaaggcgggcacttccgtcgcgcgaatccgggttctgtcaatccgtgacaacgatcatcggcgccgcgccgtccgcggtcgacacgcatgtgcggctgctcgaggaggcgatcggcgtatcgtcgctcgagcgcgtgctgcggctgacgctggcgccggccggcaagatcctgccggcaccccctgcgcaagacgccgccggaatgccggcaggtcgaccccgtgttccgccccattcgatcgggacgatgaagcgcgttgccggcgcaagcgaaagcatcgcgatcctgagcaagttcgatatctccgcgtagtaccgtcggagattccgattttccggccgatctgcgattccgcgtttcgccgcgacgtgcttgcgctcgcgtgccgcgagcggcacggcctgctgccggccggcgttgtgcttttccctccgcgccgggataatgatccggcgtcgcgcgcgatgcgcgagggaggctcccatgcaatttccgacgggttcggtggtcgcgctcagttcggccgccgcgacgatgttttcgatgggcatgctgtttctcggctactggggttgcacgagccgttgccctggcggttcggcgactacgtcgtgatcgtgctcgcgctcgcgggtttcgcgtgcctcgccagcgtgccgttcctcgcgacttcgccgatgaagaccgccggcgacgagtcgcggatgctcgtcgcgcggcgcgtgtttctgtgcggcgcaagtgccgtgtggtgtgcgattgtcgcgtcgctggtcgtgtgacgagcgggcgtgacgtctcgacccgagcggccgtccgagccggtcgaagcgccatgcgcgacaccggaattcgcgggtttccccgtcgtatcggtcatccgttcccgctttgatttccccgatgccgtgcactagattcgaagcattcatgtgtgttacagcgcgcgaggtgaagccatgacgccgtgggagattcagggcaccgaaatgatgagctgcaattgctcatacggatgcccttgccagttcaatgcaccgccgacccacggcggatgcgaagcaatgggtgcggtttcgatcgacagcggccactacggcgacgtggtgctcgacggcgtcaggatcgcggtcgtgtttcagtggccggggcggtccacgaaggccggggcaagtgccagccgatcgtcgacgagcgcgcgagtcccgcgcagcgcgaagcggtgctgaatatcatgaccggtcaggataccgatccgtttgcgacgatgttcgcggtattcgcgtcgacgctcgagcacgcgttcgagccgatcttcacgaagatcgatttcgacgtcgatgtcgatgcgcggcacggccggattcatgtcgacggcgtgttcgacgtcgcgggcgatccgattcgcaacccggtgacgggcgccgagcatcgtgcgcggatcgacctgccgaacggtttcagtacgaactcgccgagatcggttcgggcaccgggcgctcgcaaggcaacatcgtgctgaacctcgacggaacctatgcgcagttcgcgcggctgcacctgaacaaccacgggctgatccggcatcgcgcggcggcatgactccgttcgacatctggctcgggcgcgagcgcgtcgtcacgctgctcggcatggccgcgctcgtcggcgtgtgctggttctacctgtggaccggcgcgggcaccggcatgtcggcgctgcagatgacggcggtcgcgctctttccgcatcggctggcgggcgacatgggcagcatggatccgtcgctgccgaccgtgatcgcgatgtggtgggtgatgatgatcgcgatgatgacgcccagcgcggcgccgctcgtgatgctgtaccggcgcgtgctcaggcatcgcggcgcggacagcgcggcggctgcgttgacgtcgatgtcgctgctggccggctatctggccgcgtggttcgcgttctcggtcggcgcggcgttgctccaggaattgctgcaaccggccgggctgatctccgcgatgatgctgtggtcgaagagtgcgatgctttccgcggccgtgctcgcgctggccgggctctatcaattctcgtcgctgaaacgtgcatgccttcggcaatgccgcgcgccggcggcctttctggttgcgcactggcgcccgggcatcgccggcagtttcctgctcggtgcgcgacacgggatgtattgcgtcgggtgctgcgggttgctgatggcgctgctgttcgtcggcggcgtgatgaacgtcgtgtggatcgccgcgctgtcggtgttcgtgttcgcggaaaaatcctgcccggcggcgagcgcgccgggcgcatgctgggcgtcgtgctgatcgcatgggccggtgcgacgttgttcgtttgagccgggcgtccgcgtcgcggcttcgatgaacaacgggaatgtcttcggaactgcgggggctgtcgatgaagacctgctttcacgcgttcgccgcgtggtgcgcggcggccgtcgttgcgatgccggcgttcgcgggcagcgacatgcctgcgatgagcatggggcgttcgacgatgtcggcgccggatgcggcgctgacggatgccgaggtcaaggagatcgatgccgggcgcgggctggtcatgttgaagcatggcgcgctcgacaacgtcgggatgccgccgatgacgatggcgttcaaggtcggcgatgcggcgatgctgacgtcgcttcatgtcgacgacaaggtcagggtgcgcgtcgaaagcgtgaacggcacgcttacgattgtgaagatcgtgaagcgtcggtgacgacgcggggcatgtcaatgtgccgggaccggcggtgtgcggtcccggccgtttttgagtcgtgctacgtaacgccggatcggtgttacgtcggtgctgccggaacgcacggtcggatcgaacgccgcgggtggaggcgcgggcgatgtgcggcgcgggagtatggcgtcggcaggggcgctgcggtgcggcggcgggatcgttacaggaaccgacgggtatggcacggtagatgcttgcaggaaggatcgcgctgaattgcggacgggggcttccatgcaaaatcatttcatcaaggcgaacgttgcgctcgccgccattgccgcggcgtgtgcgctggcggcttgtggaggcagcgatgttacggcgccgaagccgggtggtaacaacatcggaacgagtacgagcgggacgagtggcacgagcggaaccagtggcacgagcggaaccagtggcacgagtggaaccagtggcacgagtggaaccagtggcacgagtggaaccagtggcacgagcggaaccagtggcacgagcggaactagtggcacgagcggaaccagcggcacgagcggaaccagcggcacgagtggaaccagcggcacgagcggcacgagtgggacgagtgggacgagtgggacgagtgggaccagcggcacgagtgggaccagcggcacgagtgggaccagcggaacgagcgggacgagcggaaccagcggcacgagtggaaccagcggaacgagcggcaccagcggcaccagcggcacgaacggaaccggcggcacaagcggcaccagcggaaccccggcacgaacggcatcatcagttccgtcggcgtggtcgtcatggatgccggcgccacgatcagcggcgtgagcccgcccggagtcggcaagggcgtgaccaccggcctcggcaacacggtcacgggcgtgggcacgatcatcagcgacacgtcgaacgccgtgagcaacggcatcggccagaccggcttcacggcgaaccccgtcggcacgacggtcgccgggctcggctccatcgtcggctcggtcggcaatccggtcgcgggcctcggcgacacggtgaaggcgctcggcaccggcccgctgtcgccgttggcgccgctcacgacaccggtcggcggcctgctcgacaccgtgtccggcggcatcaagacgggcggcgccatgctcggctcggccctgtcgtcgggtccggtccagcagacgacgcaggcgatcagtacggcgatcacgccgctcgtcacgaccgtcggccaggtcacgcagcaggtcggcacggcgaccggcctcggacagccggtcgcgggcctgctcggacagatcggcggcgcgatcacgtcggcgggatggaaggtgacgtccacgtcgccccagccgctggtcggcggcgtcggcgggctcgttcgcgcggtcggcaacaccgtgaccaacgtgggcggcctcgtgaacccgagcggcgcgaacggcgcggtgccggtcgcaggcctggtgacgagcgtggtcggcggcatgccggcgaccgttcgcaacggttccgcgaccggcgcggacggcggctcgccgctgggtgcgcttgccaatccgctcgcgcccattacggggctggtgggcggcctgcttggcggcgtggccggcaagtagccgatcggtccggatcgtcacggcggtaaccggccagatgaagattggcctccggttaccgccggccgggtttcttgatggtctccgcggaaagcggagcgggcggggccgctcgatgcgtcaatcgcgaacgatgtcgcgcggcgacggcggccgcgccaatccgcgtgcgggcagcggtgtcgacatcacgatcgacgtgcgtgtttcgccgtacaggttgatgcgttcgatcagttgttcgagatgggtcatgctgatcgcgacgagtcgcatcacatacgagtccgcgcccgtcacgtgatggcattcgacgacttcgggaatcgtctccagcaaccggaggaatttcgctttcgccggttgcggcaccgtgatgccgatcagcgcgctgaccggatagccggcggcggcaggattgatccgcgcggtgtagccctcgacgacgccggccgcttcaaggcgcttcacgcgctccgtcaccgccggcaccgacaggtgcacctggcgcgccagctccgtgtagctgatgcggccgttggcctgcaacagcgccagtaccttccagtccagatcgtccatcgcggtggaatttttaaggtggagccgccatttttccttaaaaaccgcattcagcgatgaccggactttcctacgatgcctgttcaacgcgtcatatgtcgcaaggagcaggcgatgctgttcatcaagtccgtcgtaatggggctgtcgatcgcggtgcctgtcggcccgatcggcatgctgtgcatccagcgcagcctgagccgcggctttcaggcgggattcgcgacgggcgtcggcgccgcgtgcgccgatgcgatctatggcctgctcggtgcgctcggcatcgcgggtatcgtcacggcgttcccgatgctgaccgtcgggttgaaaatcgctggcggcgcattcctcgtgtggctggcgtggaccatcgcgcgccaggcgccggccgcgtcgacggcgcaacgcgacctgccgcgcacgaccgtcctgcgcgatttcctgacgacgttcggcctgacgctgtcgaacccgatgacgatcctgtcgttcgtcgggatcttcgcggcgctcggcccgctgtcgggggcgcgggaaggcgcgatgtggccggccgtggcgctgatggtcgccggtgtgttcaccggctccgcaacgtggtggctgtgcctgagcggtacgaccgccgcgttgcgcacgcggatgtcgttcgggttcatgcacgggctgtcgcgcgtgtcggccgcggtcgtcgcggggttcggcgtgattcaggtgatcgcgggcgtgcgcggcgtcgtttaggtcgatgcgtcgcgcgcaatgcgctgcgaccggatcgcgtcgatagtcgtccggatatgcgcgagcaactcgagtaacaccgccttcctgaaaaactggttcatccgcgtgctgacgacgagatcggacggcaacgcgtcgatcgcacgctgaaccgacagcagatcgtcggcgagccgtgccagcgcagcgcgatcgagcgtgctcgcggcaaccgcgatctcgtccggccagaaaccgaatgcgtcgatgccgcagcatgcggcgacacagtccgtctccagtgcatcgatcaacgacatgaccccggccagacagggatcgatcgcgaccgcctgcgcctgcccgcccgacagatcgccgaattcgatccagcgatccgggccgatgccgatgtcgtccttgtggggtttgccgttcatcgtctgacgctcgacggattcaattcaatgcaggcaaatgcgcacgcacgaagcgcgcgatttcctggcccagttccatgtcctcgggtgcacccatgaacccgccatgcggcatgccttcgaacaggtgaagctcggtcggcacctgcgcacgccgcaatgcgcggtgcaggcggaccgcgttcgacaggaacaggtcgcgtgtgccgctctggatgaaggtcggcgggaaaccggcagcgaaatcgccgaacagcggcgacagatacggatgcgcgagatcggcgccgttcgcgtagagcaggttgttcggcatcagcgacgtcggcaacaccacgtcgacgaggcggttggtttcgaagctgtcgccggattcggtcaggtcgacttccggcgacagcagcaccagcgcggccggcagcggcagcccttcgtcgcgggcgcgcagcaccatcgcggcggcgaggttgccgcccgccgagcgcccgccgatgacgatgtttttcggtgcgtagcgctccagcacgtacgcatacgcggcgatgcaatcgtcgagtgcggccggatacggatgttcgggcggcaggcgatagtcgacgccgtagcatcgaatgccgagccggtcggcttgcatctgcgcgccggcgcggcatgcggcgccgccgccgagaaccagcgcaccgccatgcaggtcgatgtacgcgcattcgccggaagccactgcctcgggcgtggcgacgtgcacgtccgcagcgccggcccggatcgtctccacgcttgaacgcagatgaccgccgagctgctcgatggccgccgcgtagtgcgcgtcagcggccgccttcacgcgcatccatgcgtcgaaatcgtccggggcaggcatcacgtgcagcgcgttcagcggcacgccgtcgctgccgaccagccgttgcaacgcggctcgcgcctcttcgctgatcgaggccgggaaggggacgacacggctcggcacgaccacgccgtcgggttggtctttcatcgattcagctccgttgggcgagtcatgcggcgcaaggccagtggcgcagcatcacgtccagcgcatcgagactgcgcaaccacgacgcgtcggaagccggtgcactgtgcgagaacccgccggcgctttcgagtgtgacgtagcccatgaaaaagccgccgagcaggcggatcgcatgcggctgctcggcttccggcatgtcgtagctgcgcagcacggccgaggtcatcctgacgagccggccgccggcgcttccagtggcgcgctcgacgctcagcgggtggcgcgcggctgcaaacggccggggtgctcgcgcgcgtagtcgcgatagacgttggcgagcgctgtcagcgcgtccttggcggtacggccggccagtgcttcggttgcgcgatcggcgagttccctcagcgcgaagagtgcgatccggctcttgaggtcgtcgaaactcgggacatgggagtacaggctggcgagcttgacgtcgaagtgacgcgcgagcgctgcgccggtcaggtgctcgaagccggtctcatcggcgagctgtgcgccggcttcgacgagtttgtccagggtgatgccggcgcgtgccatgacagatgctatttaagttagtcaagcggctaattgtattaggtttggtgggattgtcaatttcccgggcgtgccggttctgcctgtgcgtcattggggtgacgtgttccggtgcgtcgaagcgctatggcttcatgtgatcggggatggctgcttgggtcgggtgtcgtgcgtcaggaagcggagacaaacatgtgccgggcatgtaagccatatccacccggctgtcgcggcgatcgggatctgcgtcgtctgcgcatcacctgttccgacgggtggcccgttgatgcccgcacgatgcccgtacctgccgtacaagggccgtagagggcggaattacccagccacgcttgctgacgttgcatcgcgtagcgacttggcgtccgccccgttcgcgacggtcaccccagctcgaacgacgtcaccccgaacacgcgatcgattgcaatcggcggcgcgtctttcgtgtacatccgcgcggtttcgaagacgctcgtcatgccgtgccgttccgccagcgcgacggctgcggggttcgtttccggcacgtcgagcacgatgacctcgccgggcatgcgcgcggccagcgcgcgaaacagcccggtggcaacgcctgcgtcgtcggcgaacagcgggccgaccttgcagcccgccttgcagcggcgcacgacaccgtatccggcgatacggcctgcgtcgacggtcacgagcgccacggtatccggctgcgcgatccacgcggagacgaaacgcgcgcgtgccgctggaaagcactggcggtcgtaggcgagcaactgctcgaacggtacgtcggccgcggcggtcacgtgcgcgcacccgatgccgtccacgcgcccctgatagcggatgttgcgatacgcgagcgcgaatccggacttccggtagttcgcctgctgggccacgacaccatcgagcccgatgttgcgatcggcgaggtaacgcatgccgtgctgccagattcggatgccgaagcccttcccgcgaaacccgggtttcacgatatagaggccgatgaaaccaaagcgttcgtcgtaggcgacggcggtgaggcacgcgacgggctcgccacgccagacgccgacgaagaacccggccgggtccgcttcccagaaacaggaaggatcatgccggccggggttccagccttccgccgccgcccattcgatcgacatggccacctcgtcggccgacatggtgcgcacgatgaagtcttcgtattgatccatgattcaccccggtcgctgcgctcgggaatgcgcgttgcgttacgtgaaatgcatcgaggaagcgtgggccggcagccccgtggctgccggccggatcatcatagtccgaagaatggaacgagtgtgtgatggtcgatgccgagccgaagcggcgatgacgggttgtatccccacgttcgggaaaatctccgtcggcgaaaaactcatggatggaaggtttcgccacgcagcagcatgtcgatgaactccccgattttgcgcgcccttgtttcgggccttttggcattctgtatgcgatacaggatcgcatagcggttacggctgttcagggttgcgaagaatttcttggcgccgggattggcgtccaaggccgcctgcaggtcgtccggcacggtcgagttgctggccgacgtataagcagcgttccagcggccatccttcctggccttctcgatttcgcacatgccggacgggcgcattctgcctgcggcgatcagtgcttcagcccggtccttgttgagttgcgaccacaggctttttgcggagcgtggggtgaagcgttgcaaccagtattggtcgtttccggcccgcttttgaccatcgatccagccatggcagagggcgctttccagcgcctgttcgtaggtgacggttcgctgcccggtgcctttttcgccagacgcagccatgcgccggttgacgtgctgccgttttccctaaccagctttcccattcgatctgactggaaaacgttagcgtgcattcggtcatgtcgatgtcctgaatggtgagtacatctacgggaaggcgtccgcagtctaacagtgttgatacggacattgacgtccatggcgcgaccgaaagaccagcagatccgcagtcaccagcctgtcgacgggtttgggtcgcaataccgtttcccatacccggtggcggaagcatcgaacaccgcttcccgacggggaccttgccgcccaccgcgccaaggcctccccatccacccgtcagaacgtgtaactcaccttcccgaacgctgtccgcccaagcgtgttgtatccatacgcggtcatgtactgccggtcgaacaggttcgacaccgtcgccgacaccgtcaggtgcgaattgatccggtacgacgcgcgcaggcccaccgtcaggtacgacggcagataggtcgagttggccggatcgtcgaacgtcgtgccgccgtaaagcagcgacgcccccgtgctcaacgcatgcaggtggagttcatcccacgtgtgatcgatgttgatgctgaccgtctggcgcggacggcggctgagccaggagtcgttggtctcgtcctgcggattcaggatcccgaccgcgatgctcaccggcgtcgagcggccgatcgtccccttgtacgacaggtcgatgccgcgaatatgcgcgcgaccgatgttcatcggagagaacgtcgccgggttgtacgcgatcaggttggtgacccgcgtgtcgtagatcgcggccgtgaacgtaccatacgacgtgttcgcatcgaccgcggcctcgaccgacgtgttgcgttccgggctgagccccggattgccgtagccggggtagtacaggtcgttgaacgtcggcagcttgaacgcattgccgtacgacacgcgcgccgtatacaccggcgtgatcgcccacgacagcgccgcgttacccgtattcaccgactgcccggcgatgatttcatggcgccccgcgaggaacatcgtcacgctgccgagcgtcgccgactgatgcagcgagaacgcggaatcgttgcgcgtcggtatgccgcccggaatatcgaccggcaggaacgcctgctcgcgcgtgaagtcgtacgcgagcttggtctcgcccgacagcggcagcccgaacaggtggaacccgcgttcctgatgcgtcaacgacgtcgacgtgctgatgcgctgcgaattgatctggtcggtcgggatggccggatcgctcgcgtagaggaactggcgatcgttcgcataaccgaacgactggtcgaactgcgtgtcgggcgtgatgtcgagatggaacgcgataccggtcgtcagctgatgatcgagctggcggttcgcataaccgctgttgtcgtaggacagatcggaccggtgatacagcgcgaacgtcgagatcgaccagttgtcgcgcgcgtagccgaggcgggcatcgagatcctgcgcgtggtacgggttgcggccggcctcatggtacggcagcacgggccgcgtcgagtcgatgccggccgtgttgtacgagcgcaggccgagcgagtaggtgagcccgccgagcgcggcgagcggcccggtcgacggcaccgtgcccgacgtgcggagctgcgtgtcgaacgtcttgttcgacccgccgccgaacgacacggtcgtctggttcggctggttggcggcgcggcgcgtgaagagctgcacgacgccgcccatcgcattggcgccgaacgacgcggctgccggccccgaaatcacttccacgcgttcgaacgcttcggtcggcaagtcggcccacggcgcgatgccggtggtcggcgagccgatccggatgccgtcgatgaacacggcgacctggttggccgacgagccgcggatgctgaccgacgcggacgaaccggggccgccgctctgcgagacggtcacgccgggcagcgtcgcaagcgcctgcgtgatgctcgggtcgctcggcgacagccggtcgagatcggtgcgcgtgagcacctgggtcgtcgcatagcgttggtcgaacgactcgggcaggcgccgcgtgtcggtcacgttgatcgtcggcaggtcggtgccttcggcggccggggccggttgcgaaaccgcggtgtcgccggcggcgtgggcgagggcgagaggagcgcggtcgcggcggacgtggcaaggaggtgtcgaatcttcatgaggctgtcgttgtcgtcgggctgcgccggagccgatcgtgagcgggcggcgggcagcaccggtcttgttatcggtgatcggttatcgcgcgaccgggccgggcaggccggtgtcgcgggcgtcggcgcggcgcatgccggcggacgcagtcgatggggaacggcacgcgcgtgcgggcgggccgtgcaggccggcggcgtgccggcgcggcgcttccggtgcggaagcggatgcggtaacaatggacatcgggcggatcctgaggtcgggccgtccatgcagcgggcgaccgccaacggcggtgcctggcgcgccgggacacccccggtgcggctgcctggacctcgggtcgatggcaggtctcctggctcgcgggtcgtcattcgtgcgggccttcccggtttcccagtggcacgcagtggcacgaattcaccgctcacagttgcgggggcagccgcagattcgaggcatggcctctcctgcgttccctttgatcccgtctccgggcaccatcagcgcgcaagggtaatggcgtgcgcgccgccgcgtcaaatatccggcgacgcagggatgcgaaaaacgtcattgccgggcaagacctttcgaaatcctttctttcaggcgtcggcgccgcgtttcatgtctgatgaaacagggtggtccgaagccgtgcgatcgcgcctgaaccggctcggcgcgaccccgtccaccggacaaacgcgcggcgaaacgcctcctcgccgccgaatccgagatgcgcggcgacccgcgcgaccggccagtccgattcgcgcaggcagcgttgcgcggcttcggcgagacactgctccttcagcgcgtgataaccggtgtgctcggccgccagccgccgccgcaacgtcgcctcgctgacgccgagccacgcggccagttcggcgagcgccggcaacgcctgttcgtgcgcgagcgccgcatcgaggaaaccgcgcacctgctgcgtccacgacacgacggccggtgccgcatcgatcaggcgaaacggaaaatcgacgagaaacgcgtcgagctcggccggctgccggatcacgcggcacgcgagctgcgccgcatcgaacgcgaaaccgtaggtcttgcggcccacttcaaccggcgcattgaacagtccgagcagtggcatcgcgtcgtcgcggcgcggatggccgagccacacgtcggttggccgcaacggctgcccgatcagccagccgaacaactgcaggtagcagaacagcccggtcaggtcgaccaggcacgcggccgggctgcgcgtacgccgcagcgaatccatccggaacagcgcacgcccgtcgcgcaccgcaagcgtcaggtgaccggcgcgcggttgcagcatttcgcagaactcggccgcacagcggatcgcgtcggcgagcgttgcgcaactcaggaggcagcggcacatcaggtcgacttcgcgcttgcgcatcggcgggtgaccgtcgccgcgcgcgacccgcgcctcgagccgctcgatcgcgtcgcggtacagcgcgacgaaatcgcccggtgtcgccgccggtcgaggcggctgcgcatcgcggtcggccggcggcgcgccgctgcgcgtgagttcgctcagcaggcgcgcgccgaggcccggcaggatgcggccgcgggccgatatggcgcgctgtttcatgagtttcccgatctgatcgttgcgacaggggccggtgagcgggccggtaggggcccgctcatcgccgccacgcaagaatgctatccacgccggccgcccgaggcctcgccggaacggcgtaggccggccgccgatccctgtcacgaacgaccacggacgacacgcgaatgatccagatcgtagacgaaatcacgctcgcgcccgagcgcattcccgacgtgcttgcgctgctgcgcgaccgctacctgccgggccacgcggcacgcgggctgacggcggctggccactgggtgtcgccgcccgtcgcggtgccggggcagccgagcacgctgtggctgacctggcacgtggccgatgcgccggcctactaccggatgcgtgcgctgacgaatgccgacgtggtcgatttctggatggcggtcgacgcgctgtgcgacgcgccgccgccatgtgatgacggacgccgatgcgccgctgcccgcgctgacggaggtcgatcatgcggcatgacacggcacaggtgttcgtgtcggggatcgcgacgccggtggcatcgaacgcgcgttgcacgaagcggcacacgcgctggccggcgcgaaacgcgtggcgctggcgcgcaaccaggacggcagttggggcgcgggcgacttcacgctcgacgtgctgcgcgacgattcggcggccaatggcacagccgactgcgcgaccgacggcaccgcggatttcgccgcgctcgcgcaactgcctggcatcgtacgcatcgacggcgccgtgtgccgcgcgatcggcggcggcctgcgcgaacccgcgctgcgcgacggcgtgtggcgcacgctgatgttgcgcgtgcggccgcaggccggcgccacgcaggtcgccgcgctcgaacgcgaactgctgcgcatgcccgcgtacatgcccggcatccgcaactggcgcctgagccggatcgcgacccccggcgcatggacacacgtgtggcagcaggaattcgcgcgcgccggcgatctgctcggcgaatacctgatgcatccgtatcactggggctgggtcgaccgccggttcgatgccgaaagccccgactggaccgtcgatgcgatctcgcatgcgttctgtccgctcgcgtcgagcctgctggccgagacggcggcgtgacgcggcgcgcccgccaagctgacaccacccctggagacacgaagatgcgagccctgttgatcgatcgcgccggtcattccgacgtcttgcggatggccgacgtgccggcaccgacgccgggccccggcgacgtgctgatccgcgttgcctttgcgggcgtcaatcccgccgactggaaatgccgcgaaggctacctcggcgcattcatgcagtacacgtttccgttcgtgatcggtttcgacgcggcgggcgtggtcgaagcggtcggcgacggcgtcgacggtttcgcgcccggcatgcgggtgttcgcgcagaccgacgtcggcgcggggcgctggggcgcgtatgcggaatacgtggcggtgcgccacgactcggtcgtgcgcgtgcccgacacggtgagcctcgcggaagccgccacggtgccgacacccgcgcttgccgcgtgggccggcctgttcgacgacggcgggctgaaggccggacagaccgtgctggtgcacggcggcgcgggcgcggtcggcacgttcgcgatccagctcgcggtgcaggccggcgcgcgggtcgcggcgacgtgttccgcgcgcaaccgcgagacggtcgaatcgctgggcgccacggcaagcatcgactatcgcgcgcaggacatcgcggcggcgctgcgcgcatgggcgcccgacggggtcgacctcgtgcttgacgcggtcggcggcgacacgctgcccgacgcgctcgacttgccggcaccgggcggcacgctggtgaacatcatgacgctcgcaccgggcgacgcgcagcggctggccgcgacggccgccgaagccgcccggcgcggcctgcgcaccgcgatgacctacagccggatgccgagcggcgccacgctcggccggatcgcggcgcaactcgagcggcgcgcactgcgcgtgccgcgcttcgaccgatttccgctcgaacaggcggcccatgccctcgatctcgttcaaacgggcgaggcgaaaacgaagctggtgcttcatgttgcggatatcgccggttgagcggcccgcacgcccatcacaggagacaacgatgaccgatacccgaaccggcgtgctggccggcaagtgcgcgctcgtgaccggcgcaagccgcggcattggccgtgcgatcgcacagcgcctggcatccgaaggcgcgaccgtcgtcgtgacggcgcgcagcctcgcgcaatcggccacgaccgccggcacgctcgccgaaacggtcgcgctgatcgagcaggcgggcggccgcgcgattgcgctcgcggccgacctgtcgaacgcggccgagcgcgacgcgctcgtcgggcgcgcggcgcaggcggccggcggcctcgacatcctcgtcaacaacgcgggcgtggcggactatgcgtgcgtcgacgcgatgccgatgacgatgttcgacacgacgatcgaacactatctgcggattccgttcgcgctggcgcaggccgcgatcccgctgatgcgtgcgcgcggcgccggctggatcgtgaacgtcggctcggtgacggcgctgccgccgctgcgcccgttcgacgatttctcgcgtgcgggcggcgcgaccgtctacgcggcggcgaaggcggcgctgtcgcgcttcacgcaggggctcgcggccgaactcgaagccgacggcattgcggtgaatctcgtcgcgccgagcacggcgatccgcacgccgggcgccgcgcgctacatccccgaaggctatccgaccgaggatgtcgcgtatctcgcggaaaccgcgctcgcgctgtgcagcctgccggcgcgcgaacgcaccggcctcgtcacgcacagcctgcatttcccgctcgcgcagcagctcgcggtgcattcgctcgacggccgcacggtgctgccgccgccggtgattcccgcgtatgcgcatccccacatcgaccccacaggactctgatcgacatgacgaacccgattcgcttcgacggcggtaccgccgtgatcaccggcgcggccagcggcatcggcagcgggcttgcacgccatgctgccgggctcggcatgcgcgtcgtgctggccgatctcgacccggcgaagctcgacgcattcgccgcgacgctcgataccgacgtgctgtgcgtgccgaccgacgtcagccggccggaagccgtcgatgcgctggcggaagccgcgtggcagcgcttcggcggcgtcgacctgctgttcaacaacgcgggcgtgatggcgaccggcttcgctgggaaatcacgccggagcgcttcgagcgcagcttcgcgatcaacgtgcacggcgtgctgaacgggatccgcagcttcgtgccgcggatgctcgaacgcaatgtgccggcgcgcatcgtgaataccgcatcggtgggcgggttcctgccgagcccgctgatgtcgccttattcggcgacgaaattcgcggtggtcgcgctgaccgaatcgctgtacggagaactgaagatgctcggtgcgccggtcggcgtgtcattgcttgcgcctggccccgtgcaatcgggcatcttcaacgacccgttcggcgcggtgcacgaccggcccgaagtgcgcggcttcgtcgacacgatgcgctcgatgctgaacgcgcacgggctcacgcccgacgcgttcgccgagcgggtgttcgacggcaccgtgccgggcgctactggctgattccgcaaccggagacgatcgacggcgcgctgcagcggcgcaccgacgacattctggccgcgcgcgatccgtcgttgccgtcgttctgagggccgggcggcagcggcgcccggcgcgggccgtcacatgtgcgtgccggaatgcgtgcggccgctcgggtcgccgccgcgatcgggggcgtattgttctggtcgatcttcgcgagcacgaagccggcgtgcggcaacgcggcgggcgagcggtgcgtcgcttgcgcgatggcgtcgtgcggcgacgcggcgggaaaccggatgacgtcacgcccggttgagcgaacgccgaaaggaagcggccgccagggcggcggcgacgatcgcgtgcgttttcatggtggctccttcacgactgactgcgcgacggattgcgggacaacgtaatcagtctagggcgcgaaacttaacgcggcgtgaaggcgtgatgcggcgggatgcggcgcggatgacggaatggtcatgcgcgccgcgatggtcaggccgacgccgacaccagcgtgcagaagttctcgagatcgacgttgccgccgctgatcaccacgccgacgcgcttgccttgcagcgcgtccttcatccgtcgcacggcggcgaacgacaggcagccggtcggctcgaccacaatcttcatacgcgtggcgaagaagcgcatgcagtcgaccagttccgcgtccgtcgcagtgaggatgtcgtcgacgtcgcggcggatgatcgggaacgtcaggttgccgaggtgctgcgtctgcgcgccgtcggcgatcgtgcgcggcgtgtcgatatgcacgatcgcgccggagcggaacgattgctggccgtcgttgccggcttccggctcgacgccgtacagcgttgcgtgcggcgacagcgcgcgcgtggcgatcgcggtacccgacagcaacccgccgccgccgagcggcgtgaataccgcgtcgagcgggccgacttcgtcgaacagttccttggccgccgtgccctggccggcgatcacgtccgggtggtcgtagggcgggatcagcgtcagcccgtgccgcgcggcgagatcgcgcccgatctgctcgcgatcctcggtgtagcggtcgtaggtcacgaccttgccgccgtagccgcgcgtcgcggcgatcttcgcggccggcgcgtcctgcggcatcacgatcgtcgcgggaatgccgaggatgcgcgccgacagcgcgatcgcctgcgcatggttgccggacgagaacgcgacgacgccgttgcggcgctgctccgcgtcgaagcgcgacagcgcgttgaacgcgccgcggaacttgaacgcgcccatgcgctgcaggttctcgcacttgaagaacacctgcgcgccgagcgcttcgtcgatcgtccgcgacgtcatcaccggcgtgcggtgcgcatggccttcgagccggccgcggcggcggcaacgtcgtcgtacgtggggagagtcggagcgttcatggtcgtttggggtcggaaaggtcagtcaacagggacgccgcgcgcacggcgcgccggaatccggaatcatttcgcatcgttgtagacggtcgcgcgcgagacgccgagatgctgcgacacgatttccatcgcgcgacgcacttcgaggaaaccgtcggccttcagcgcctgcatcagctcgcggcgctggtcggtcttcagttcgcgcggcgtcgtcgcgaggcgcatcgcgaatgcgtcgatgcgttgccggatcgcgtccgcgccggccgggtcgagcgtttcggcgacggcttcgccgtccgtgctgcagaactggttcagcatgccctggaagccgcggaacagcgtggtgtcggcgttcaggcacagcgcggccacgtagcggccggtcgaatccttgatgccgatcgacgtgcttttcgcggtgcggccgtcggcgaagcggttcgggtagttcgcgagcacttgcggaaatcgtcgtccgcgatgcgggcgaggccgagctcggtcgcgggatcgccgactgcgcgtcccgacaggttgttgtggatcgcgagaatcgcgtgcttcggcgtgcgcaggtcgtgaaccacgacctcggtgaacggcgcgaacatcgcgccgagcccttcggcaatgcgctgcacctgttcgatcagcgatgcctgctcggacggcgccttgttccgggtggtggtcatggtggtttcgcgttcggggttcggatcgatgcgacggcgtcgggaaacgggcgaccggcggcgggcggcgggctgcgggcgggttactcgccgtccgccgcttgcggccgcgtgatgtcggcgagcagcggctgcgtaatccgcacgtagtcggccgcgtcgagtacgacggagcggtcgaggcggcccgcgttgaatgcaatctcggtgttgtgttcgaccagtgcgggatcgacgacgagcgtcacgccggcgtcgaacacgaacggcggcacggcgcccatcacgcagcgcgtgacggcggccgcgagatcgggcgatgcgagtgtcgccttgcgacggccgaccgcatcggcgaccttgcggaaatcgatcttcaggtggccgggaatcaccgcgagcgcagcggcgttgccgccgtccttgaacgtgcacagcattgccttcgcgccctgttcggggcgtgtgccgcgcagcgcggcgatcgcgtcgcattttccttcggccggatgttccagcacgcggaatcgtgcgccggacgtgttcagcagatcgcaaagcgtgtcgaaaacggggtagtcgctcatgtcgctccgggcaggcggggccggggaatcgaggcgcgccaggggcgaatgctttagcgtgccggtcgatggattgtccaattatagacgttttgtcatgggcgtggcaaagatgcgtgtgggcgaggcgtggagggcgctacgggtgggaaggggatcgacaaacagttgcgttgcgcaatgttgatgagcgccggggaatggccggcgcgcggccggttgaaggatgaggaattcgggcgacgggaatcgcgacggggatccggcgccagcgtcatgccgccggccaggacgggagcgcgcgatccccgccgttacttcgtcaatcctcgctcctcccatcggtcccaggtcttcagcgcttgacgcgccgtcctgccgaacaggaacgacagcgtgtcgcttttcatcgacatcgatttgcggttcacgatccagaagtccgtcaaggccgtttgcttcccgctcagcatgtccgcgatcgtccggccgttgaggtgcgtcagcgcgacgccatgaccgaaacatccacccgagtagatgatgcgttcgtcgtcgatgaaaccgattttccgcgacgatggaggcctacgccaatacgtacgacagtgtcagcgcggacacgtcgctgacagccgagggccgcctggagaaagtggtcaggttgttgctcgaggacggcaagcagccccggacgcaaagcctgttcgtgaacttctgggcactggcgcagactcaggagttcgcgcggaaaatgctcgaagagggatacgggtttcaacggcgcgtgatcgccggattcatcgaggccgtgaacccggcgctgtcgcaagccgcgctcgcgaggcgagccgcgctggttaccgcgcagatcgagggctcatcgtgttgataccgcaaagaaaccggttcccgtcggatatcaagggaatcgaggacgatgcggtgatggccgttctggctttggccaaggcgccatgaattgaatcgctgcgatgcggttcgacgtctccggcatcggctcgagcggtcgaagcccgtcgagcccacgcgcagagacgttgacgcgacgaaacttgcttgcaactggctggaaacaggatctacgaggagaacacgggcaatgtcgatcggcatgcaggaagcgcgcggagatgattcatcctttgggcggcgagactcacgcgcccgaagaagcaggaaactcgacttttgcatgcaaacggtgctgacgctcgtcctggcgctggttgcgcactgcgcgtttgcgtcgagcaacgtgaccgacgacgagcagcagcaagctgcgttgcgtaccctgatgggcacggacccggccccggcagacagtgtcaagggtgtcgcgctgtcaccatgggcacatgggccgtcggcttcagggccgctttgggtcgtggccgcattggtccagcgcccgaccgagaccgtcgacgcggagttgtggacaggtgtgctgacccgcgacgggcaagggttccgcctgctcgcgagcgatcggagcgagcgcgtcgatacgtcaccgatgttatggagtgcattcctggccatggacgtcattccctaccggatcagcgcgcaagaaactgcctttggcgtgctcttcggcaataactacacgtcgaccgcacatagcgattcgaccgggatactgagcctgtaccgttatcgcgatggtcgcgtgacgcccgtcttctccgcgctaaccgactggtcgacctatgacaaggacggggctgcggaatgtgaggagaagaacgacggaaaacgcgggaagccgggcgatgcccggccggattcctgtgatgcggaaaatacgacggagacgcattacgtgctgtcgttcagtcctcacgtgacgaacgggcactacgacctccttgtgcgtcccaagggaaaggccggggcgggcaagtccgcacgttttacctggaacgggaatacgtatcagccgcgccggttcacgggtgactgacgggcaagagcggggcggcctcggtcaattgcatcggacaggtgtcggccaggtacgacggcttgaacgagccgcttccgtcgctggcaattgatcgcggtgttgccaggacgtcgtggccatcccaggaagacgtcgagggtttcatgcgcggccagggccgatggcgacggcgatgttcgcgagcatcacaatggttttcgcccttcattcgagagatcctttacaaaccatgcagacggaaatcgaagcaccgggcccggccggcccgttgaaaggcacgcttttgtccccgggttccgacgacgccccggtggtgctgatcgtgccgggctcgggcccgaccgacaggaacggtaacgcgccgaacggggttcaggcgtcgacctatcgattgctcgcggagggattgcgcgatgaaggaatcgcgtcggttcgaatcgacaagcgcggcatgtacggcagcgcgtcggcgataccggatgccgatgacgtcacgatcgacgagtacgcggccgacgtccgttcttgggtcaccgccattcgcgcgcggatgggcgcttcccgggtgtggctgttgggccatagcgagggcggatgggtggcgttgtcggctgcccggcaaatggacgacatcggcggcctgatcctggtatcgacggcagggcgcccgctagggccgtgttgaggcaacaactgcaatcgaacccggcaaatgctccgattcttgccaatgcaatgtcgatcctcgaatccctggaggcaggtgaacgggtagacgcagccaggatcgacccggcactcatgccgttgttcaggccgcaagtccagcgcttcctgatgagcgagttgatcctcgatccgacagcgctgctggccggttacatgaagcctgtgctcatcgtgcagggggcgcgggatatccaggttggcgtacaggacgcggaactgctgaagcaggccaatccgcgcgccgaactggcgttgatcgccgacgccaatcatgtgctcaagacggttcgcacgtcggcgctgcaggaaaacctcgccgcttattcgaacccggatctgccgctggcggacggcgtggtggaggcaatttcggcgttcgtgcatgcggcgacagcgaatcggcgctagttccggtcgaatccggttgatccgtcagggcggcctttatcgaagcaggcaccggtcaaatgacgtcgagtgtctgctgtcgggatgcgggcatggtcacttcaaccaccttcggtcgaacgcgtcgatcaggcgccggcgcagtacgcgacattcgacggacaaacgtcaatcgccgacaatcgtgcgccgtcaacgattcagataatccgtcacgcgcgcctgcaaatgcgtgatcgcatcagtgagctgcagatacgcgtcgacatccatcagcgtccattcctggccttcattgccgaaacggatcgcggcgatttccgcagcgctcagccaaccggcgaagaaccagtgtggcaggcggtcgggtcggctcgacggatagaccctggaccaacctatccggctgcccggtatcgtcagtccgaattcctcatggagttcacgcaacacgcacgcttcgggcgtctcgttaccttccctgcctccgccgggcaggtcccacagaccgggaaacgggatgtcgggcttgtcgtcacgtcgatagacgaggatgtcccggtccttgaagagcgcaatcttcgaaccactgaagggggcaggcgattccatgcatgatccatatcgtggaagcggggctgtcagtgtagattctcgggtatcgacgcgtacgctcgatttgaaatatgcatccgcgtggcacgacagcgatgtcagggcgcggtacagccgataccgccattgaacgttgaaagctggaaatcgaacatgaagacttttgccataaggaacggccaatggggaatccggtatcacgatctccccgggcaagggataccgacattcttcgttcacggattggggtgcgcgtcctcctgcgattatccgggcgtcatggcacagcctgctttgtcggggcatcgggcggtgctggtcgatctggctggattcgggttcagcgatcggcccgtggacttttcctacaccattcaagagcatgccggaacgatcgtggcactcgccgatcatctggcgctgtcgtcgctcaacctgttcggtcacagcatgggggcgcagtggcgatcgccgcatcgatgcagctcggtgagcgggtgcgacatctcgtgctgggcgagcccaatctggagcctggaggcggctttttcagcagaaaaatcgcggcgatgacggaggcggaatatgtgcaagccgggcacgccgcgctgatcgccgaatccgccgccggcggcagcgatatctgggcggcttcgatgtcggccagtgctccgtacgccgttcatcgaagtgccgtgtcgctcatcgagggcactcatccaagctggcgcgagcagctccattcgatgaagatgccgagaaccgttttgtttggtgcacgctcgctgcccgatgtcgacaccgaacgtcttcccgcggaaggggtgaacgtcggcatcgtggaaaacgcgggccattcgatggcctgggagaatccggccgggctcgccttggcgatccggcaggcgctcgagtaaccggaaaaccggcgtcggcaagtgtgccgtcatcgccgcgaccaatgcccgttcggtgtgtccgctttcgtaaccggctgcgagccgtcgttcgataccgggccacgacaacagaaaacgagccatgacaaacctgattcgattccgtgttcgaccggtatttcacggcagtgatctgctggtcgaggtactcgatgatcatcgtgcagcggatttcccgagcatcgccgcgatcttgcaggatgcgctgcacgctgtcgaggttccgcatccgtacggcgttgatgaacccgtggtcgcattgtttcacgaccgctacttcagctattgggcctacgcccggggccactatgaaattgacaacgatatctggggactgttcgtgacggcgtcgatcgacaactcatccgttatcgcggacatcgaaagcgcactcctgtcgacggggaagttcgtcaaggaatacgtggatttccgcaagttcgagtgagctgaaggggccgggaaagccggtgcggcaatctcgaacgacaactcccggcgccggcaaggatcgccccatgcgatccccgaactcaccccgcactgccttcaccacatactggctcgtcggtagcacatcgatcttgtcgaagtcgatgaagcgcccacagctgtccatcatctcggccacattgcgctggaatttttcgtcatcgcccaccgcatcgaaaaacgcatgcggatcggtcatcgccgcggcgggaaagcactcctcgacgatcgcgtcataaccgggcgccgcatgcgtgagcgcgcgcacgacgacgttctgcacgtacaggaaattgtcctgcgtatcgatcgcgacgcgcgtgtgatgcccgtgccacacgtctagccatgcttcgtgcgtgaggcgcggcggccgcttcaggaacgcgagctgcgagaagcccgtggtgcgctcgcccggccgtgccggaaagcgcgtattcggaatcggttgcgactcggtgacgagatacgcagccatgtgcgggacgattgcacgcaccgcgtcgtcgaacggctggcggaacatcgcgtttgcgctatcgacccacaccgcgacgatcccgtcgatgcccgggtgcgtgttggtctgcttcaggccggcggccggcgcgacgtccgcatccgcgacgttcacctgcacgccgtgcgcaccgagcgacagcagcctgtcggcgagttgcgcgcgcaccgtgcggctccactgatcgggcgcagcctgcgcgtcgcgccacaacacgtaaatgactttctccattgctccggctccagagggaatgacgggatcggcggcgttgccgccggggttcaggaagcggtttcgggcgatccggccgacgggtgtgcgtccggcgcgaaccggttcgcggtcagcgtgagcgacggcggaatcggggacgtgacggtttcgaacaggcgctcgtggcgcgtcgcgtgaatgcgccacgcgccgtcgcgtttcacgtactggtcgtcgtagaacgcagtgccgtgcagcaggtagttgtcctcgagattgatcgcgtgatcctcgagaaaccacacgccgcacgcatgatcggccgagaccagcgtgagctcggggtgatggccgtgatgcatcgtcaggaaggtcggcttgccgatcagctcgcgcaggctcgacacgaatgcgtcgcggccctcgtacacgtagcggccgccatacaggcgggcctcgcagtcttcggtcaggcaatccgcgagcagcgcccagtcgtgcgtgtcgaccgcgcggaaataccggtacttcaactgtcggatctgctcgtactcgtggagcgtgcgggtcgtgtcgtccatcgccgggtctcgtggtggtgtcgttcgatggtaggaacgaagccgcctgcatcacatcgtctgttcggacgaacgcgccgtacgcatgcgcccggcgctgcgaggacgaatcgccggtttcatccgaacgggtgatggccgacgcatcgcgcggcggtaacgtggcatcgacgcggccatcgaaccgctccggcaccgaacaaggagacaggatgaccctcatcgaatcgctggaagcgcgtgtgcgccggctcgaggatgccgacgcgatccgccggctgaaggcgcgctacttcacgtgctgcgaccgcaaggatccgcaggggatgcgcgactgcttcgcgcccggccacgtgcacatcgactacggccgcatcggcacgttcgacacgcgcgacgcgctcgtcgacgtattcgtgcaactcggctgccatccgcacatcgtcgagatgcatcacggcgtgaatcccgagatcgacgtgctcgacgacgtgcatgcgcgcggcacgtggggcctgcactaccagatgatcgacacgaacgcgcgaacgctcacgcagctcggcgcgtactacgacgacgaataccggaagatcgacggcgaatggaagatcgcgggcacgcgctgcgtcgtcacgtcgacgctgtcggcccgttacgaaggcgatgcgccgggcgtgctgttcgccggtgcgcagccgccggccgcctgacgcacgccagcgccttgcacatgacgcacattccacaggagacatcgaacatgacacagaaccacgatgcgccggtcgccgtcgtgacgggcgcatcgcgcggcgcgggcaagggcatcgcgcgcgcgctcggtgcggccggcatgaccgtctacgtcacgggccgctcgcagaacgaaggcgacgcgccgctgcccggtacgatccacgagaccgcacgcgaggtcgatgcgctcggcggccgcgggatcgcggtggcgtgcgaccacgcggacgacgcgcaggtgaaggcgctgttcgagcgtgtcgaacgtgaaagcgggcggctcgacattctcgtcaacaacgcgacctacctgcacgatcaactgatcctgccgggcccgttctgggagaagtcgctcgacctcgtcaacatcctcgatgtcgggctgcgttcggcctatgtcgcgagctggcacgcggcggcgctgatggtgaagcgtcgcagcgggctgatcgcgttcacgtcgtcgttcggcgcgagctgttacatgcacggggcggcctacggcgcgcagaaatccggtgtcgacaagttcgcgaaggacatggccgtcgacctgaagccattcgacgtcgcggccgtgtcgatctggatgggcccgctgcgcaccgagcgcacgacgcgcgtgtgggaagaacacccggatctgtacaaggaattctcgctcgtcgcggaaagcccggaattcacgggccgcgtgattcacgcgatccatggcgatccgcagcgcatggcgttgtcggggcaggtgctcgtcggcgcggaagccgcgctgcagtatggcatcgccgatctcgacggcaagcagccaccgtcgtaccgcgaactgctcggcgggcccgtgcaggcgcatccggcgatcgtcgcttaaggagcgcacatgggcatcctgaaaggcaaggtcgcgctcgtgacgggcgcagggcagggcgtcggccagggcgttgcgcaggcgctcgcggcggaaggcgcgcacgtcgcggtggtcggtcgtacccgcgacaagctgctcgcgacctgcgaggcgattcgcgtgcgtggcggcgtggccgagccgttcgtgtgcgacgtgatggacgccgcgcagatcgtggcgtgcgtcgacagcgtcgttgcgcgcttcggcggcgtgcagatcctgatcaacaacgcgcaggtcgtgccgctcggccgcctgcttaacgtaaccgatgcggatttcctcgcggggctcgagtctgggccgatcgcgacgctgcgcatgatgcgcgcgtgccatccgcatctgaagggcgacggcgtgatcgtcaatttcgcctcgtcggccgcggtgcgctgggatgcgtccggctacggcgcgtacgcggcgaccaaggaggcgattcgtgcgctgacgcgcgcggcagcctgcgagtggggcgtggacgggatccgcgtgaatgcggtcgcaccgcacgcgttgtcgccgggcctgaaaggctgggtcgatgcgaacccgcaggaagccgccgcgtttttccgcacgattccgctcggccgcgtaggcgactgcgagcaggacatcggccgcgcgatcgtgtttctggcgagccgcgacgctgcgtatctgacgggcgcgacgctgccgctcgacggcgggcaggcgtactggggctgacggcggcggctaacgacggcggctgacggcggaggcgcgcggcaccggccgcgtgccgatcatgatccggcaagtgcgtgcacgcctgcgcgcggcggccggcaaaccggaatcgaagagaggacgacatgggtcgactggaaggaaaggtagcgatcgtcacgggcggtgcacgtggcatgggcgcggcgacgtgccggctgttcgtcgcggagggcgcgcgcgtcgtgatcggcgacgtgctcgatgcggaaggcgaagcgctcgcgcgcgagctcggcgacgcggcgcgcttcatgcggctcgacgtcgccgacgaagcgagctgggtgcgcgtgaccgaagcgacggtcgagcagttcggccgtatcgacgtgctggtcaacaatgcggccgtgctgacgttcggcggcatcaccgagctgtcgaaacgcgatttcgagcgtgctgtgtcgatcaacctcgtcggcacgttcgtcgggatccggacaatcgcgccgcgcatgatcgcgcagaagcgcgggtcgatcgtcaacatctcgtcggtggacgggctgcgcggcgtgaacgcactggccgcgtacgtgtcgagcaagtggggcgtacgcgggctgacgaaggtcgcggcgctcgaactcggccatcagggcgtgcgcgtgaattcgatccatccaggcggcgtgaacaccgcgatgtcgaacccgaccggcgcgccgctcgaggaaatcaacaagcaatatgcgaacgtgccgctgcaacgcgtcggcctgcccgacgaaatcgcgcgcgcgacgctgttcctcgcgagcgacgaagcgtcgtactgcaacggcgccgaactggccgtcgacggcgggatggcggcaggcgcgtattaccccggattgccgggcgcgccgttttgagcgggtgggcctgccgcacgttctcgtcggatgtttgtgtacgcaacctaattcagggtttgcctgactagcgaaaacgtgaattcgcacggcccgcgcgatcgctggctaaacgcgggcgcggcgggccggatttgccgcttccgcgaaacccttgttggacggccgtcctggcgcgtttcgcccccgaaacgcgcgcaatggcgttgtaaaaataattcacaggcaaccggcgtgccggatcgccgacatgattgtttcttgttgcaacgcaacgtttgccaaataacggcgatggtatgctggtcgccatggagttgtacggcaggttgcttgcatggcgaaactcgcgttcgcaccttctaacgagacgtcaccttctctcgcacgcatcgcggcatcgacacgcgctccgctcgcgtgtcccgtcctgcgcgccgccgcaccctgcgctccaatcgcatccccatctcgcgggctcgccccgcatccccatcctcgcccaataatctggagacaccctcatgtcgcaaaacaatctggccgaagcgacacacggcccgctgatcgctccgccggctttcgtcaaacatcgcaagctgatcgactgggtgtcgcgcatcgcggcgctcacggagcccgagcgtgtcgtgtggtgtgacggttcgcaggaagaatacgacgcgctgtgccaggagatggtcgaccagggcacgctcaagcggctgaacccggcgaagcgcccgaactcgtatctcgcgcaatccgatccgtcggacgtcgcgcgcgtcgaggatcgcacgttcatctgcgcggcatcgcgcgacgacgtcggcccgaccaacaactggatcgcgcccgccgaaatgcgcgagacgctcaacggcctgttccgcggctcgatgcgcggccgcacgctgtacgtcgtgccgttctcgatgggcccgctcggctcgccgatcgcgcacgtcggcgtcgagctgtccgacagcccgtacgtcgccgtgaacatgcggatcatgacgcgcatgggccgggaggtgtacgacgtgctgggcgaggacggcgatttcgtgccgtgcgtgcacagcgtcgggcatccgctcgaagccggccagcaggacgttccgtggccgtgcaacccggtcaagtacatcgtgcattttcccgagacgcgcgagatctggagtttcggttcgggctacggcggcaacgcgctgctcggcaagaagtgtttcgcgctgcgtatcgcatcgacgatggggcgcgaccagggctggctcgccgaacacatgctgatcctcggcgtgacgtcgccggccggcaagaagtatcacgtcgcggccgcattcccgtccgcgtgcggcaagacgaacttcgcgatgctgattccgccgcagggcttcgatggctggaaggtcacgacgattggcgacgacatcgcgtggctgaagccgggccgcgacggccggctgtatgcgatcaacccggaagccggcttcttcggtgtcgcgccgggcacaggcgtgaagaccaacccgaacgcaatctcgacgctcacggaaaacgtgatcttcacgaacgtcgcgctgacggaagacggcgacgtgtggtgggaagggctgaccgacacgccgcccgcgaagctgaccgactggcagggcaacccgtggacgccggagatcggcaaggagacgggccgcaaggcggcgcatccgaattcgcgcttcacggcgccggccgcgcagtgtccgtcgatcgacgacgactgggagaacccggccggcgtgccgatcgacgcgttcatcttcggcggccgccgttcgacgaccgtgccgctcgtgaccgaggcgcgcgactgggtcgaaggcgtgtacatggccgcgacgatgggctcggagacgaccgccgcggcggtcggccagcagggcatcgtgcgccgcgatccgttcgcgatgctgccgttctgtggctacaacgtcagcgattatttcgcgcactggctgaagctcggcaagcagctcgaaggcgccggcgcgaaactgccgaagatctactgcgtgaactggttccgcaaggatgcgaacggcaagttcgtgtggccgggcttcggcgagaacatgcgcgtgctgaagtggatgctcgaccgtctcgaaggcacgggggcggcggtgagcatgcgttcggcgtgtcgccggcatacgaggacctgcactgggacggcctcgatttcacgcgcgagcagttcgacgcggtgacgtcgatgaacgccgacgaatggcgtgaggaattgaagctgcatgcggcgctgttcgacatgctgaagctgcgcctgccggccgaaatgaccgacacgatgaagaagatcgagcagcgtatcggcgcctgacggcccgcatcgacgttgtcgttccgacgtcccgccgccggcattcgttgccggcggcgggacgtttttgcatttccgcttgtcgtcatgcacgcctttctttgtccggtgcggccggcgtcgcagtatccgtttcggcaaccccagccgtatgggtgagtgcggtaacgcacgattgccgtcaaccgatcctggaaaatcgaagcgggttgtgcttgttagggcaagagggtcgctttatcgagccgcaatcaatatcgccgcagtcgaaacgaagacttgggcggctattaaattgggcgctccgtttccttgccggtgaactcggcgcaaaacaccaggcgccctgatgaaaacgcatggggtgtctcaatgatcgccaaagcaatacattggctctcgaatgtggttagtggcgcactgtccgcataccgatatgaccggccgcgttcggcatcggccggattggggcgggccgtgcttttcatggcgatgttcgttggccaacccgcgatcggccaaaccaatacgccggtgccggcaatcaacctgggcagtgaaatcaacgacatcatcaacaagaacgccaacgatccaacgcaagccatcaacaactacatggccggtctcgcggcgacgaacgcgcgctgggtccggatcgatatcaactgggcgcggattcagccgtcgcaaaccacgatcaacgtcaatgaccccaaccctggggccagcagcggattgaactggggagtgacggatacgatcatccgtgcagcccgcaacaatggccttcgcgtactgggcctgatattgcttactccgccgtgggcggccagttcgaagtgctcgagcagctatcaacaagcgaacggggtttcatcctggttatgcgcaccggatccgacgttttataccaattttgcccgcgccgcggccaagcattacggtagcgacagctacggtggacaaatcgatgcttgggaaatctggaacgagccgaactgcggtatcgatttcatgccccacgatccggtgctgtatacgcaaatcctgaaaagcgcctacccggcgatcaagcaggctaatcctggagcctacgtgtatgcagggggaagcgcggcatgtacgacatatccgaacaatacgagcggcacgctgccgtcgaacggtgtggtcggactcgtcaactcgaccaatccgagttatcccgcgccgactcagtgggatccgcgcgactggctggccgtgatgtacgcgagtggcgcacacgggtatttcgatgcgctggctcatcacccgtactgctatttcgacgactggcaatcggctcaggaccaatgccccagcacgacgctcaacaccacgtttccgcaatactcgaatgcattcaacatgatgtggcacaccttcccgtcgccgtcgtatgcgtggccgtcgagcagtggcaactcgttttcgagttacacgggaacgagcttgcgcgatcagatgaatacggcaggcgatgccgcgaaggccatcattctcaccgaattcggtgcacccacgaccggtacggatggcgcgaccaatttcacgggacaattgggcggctcgtcgacgcaatacacgaatgccgattttcggaccatgcagaatgcgccatttctgacgcaagcgaaccaggcgcgcgaatatcgtgcgctgatggcatggattgcgcagcaaccgatgggggcatacggaccggtgtatgcgtactgctattccgacatggcgttgtcattgccgaacagcacgaacatctacgagccgtatttcggcatcgtgacgcttggcgctgcgacgggttctaacggcacgcctggtccagcgaaaatcgagggcacgtctcaggtgaagtcgagtcagtactatcccgcgtggcctgatttcggtattaatgcacgtgcggcggcagcgggcactaccggttacgcgccgattggcccgggctggttcaatgcgttgggcaagtaggcgtatcgaaccgaccgcagagtcgcgcatccggattcgcacttcacgactccggacgtgcagtacccactggccgaggtgtccgactcgataacgaagattgatctatttatgggcgcctgacgataggcatcgacgcttcgatctcgtcgcctactgcgcgcggcaatgcgcaacgacttcatcgactgcacgctgcacatcgccgcgccggtagcgcagcagcgcgctgtcggcgggatcgggttcgtacgacacgacgttgccgcgccccgtgtagatcgcgatgtcgggcaacagcggatgctcctggtcgagcgacgggacgtcccgcggattgcccgccgcgcggaagaaggccgcgaagtagtcggcgaagctgaggttctcgtcgccgacgaggtaggccttgcctgcttcgccgcgctgcagcgcgccccagatcgcttccgacagcgattgcgtcgagatgaagttgctgccgccggccggcccgaacacgggcagccccgcgaactggccgtgtgcatagcccgtgtaggcagcgaacatctcgttgcgcagccccggcaccgacccgacgacgaacggcgcgttgacgctgcagacggcgaacgactgcgtcgcgagcgcacggacgcgttcgtcggcgagatggcgcgagcgcacgtacggcaccgtgtcgacgagcgccggcgcgacctgcggatagaagctgccgaccagcaccgcgcgcttcacgccggcgtcgcgcgcgagcgcgaagaagcgcggcaccgcgtcgacgttcgcgcgctcccagtgcgcggcttcgtcggtgccgggcggcaggtggcgaatgtcgttgccggccgcgaacaccaccgcgtcgaacggcgcgagatcgtcgcgcgtgaagttgccggccacgtagtcgcgcagcaatacgtcgaactgcgcgagcgcgctgccgggggcgggtggcttgcgtgcggcgagcgtgacggggttgccctgcgcgtgcaggtgcagcgcggcatggccgccgatgaggccggtgccgccgacgatcaggatcttcatggtgtctccggtagcggcgcatccgcgccgcgtgaaatgaacaggcgggcggtgccgctcagaaattcaagccgttgcccgtgacgacgggcatgttggtccagaagccgttcgggtcgcgataccagccggccgccgcgagcgcgccgccgtcgacatgcagcgtcgtgccggtgacccacgcggcgagcgggctcgccaggaacagcgcggcacccgcgatatcgccggccgcgccgaagcgcccgagcgggatccagcgcgggatgtgctcgcgatgctcggccgcgaccatcgcgctgacgggcacctgcggcgtctcggtggtttcggggcgatctggttcacgcgaatgccggccggcccgagttcgagcgcgaggcttttcgtgaagccggtcagcgcggccttgaacgacgcgtacacggtgcagttcggaatggcgcgaaagccttcgatcgacgacacgccgacgatgctgccgcctgcgccgcgcttgcgcagcaacggcagcatcgcgcgcgtgacgacgaacacctggcgcaggttcgcgtcgaacagccgcgcgatgtcgtcatcggtgcagtcgtcgaacggtttcgcgatctgcaggaagtcgcccacattgttgacgagcacgtcgaggccgccgaagcgcgcgtcgacggttcgtgcgaacgcatcgacctgatcgcggcgcgtgacgtccacggtgccgacgagcgcgtcgacgcccgccgcctcgagcgcctggcgaacgtcctgcgcgcgggccgggtcgatctcggcgaccgcgacgcgcgcgccggccgcgccgaacgcttccgcacacgcacggccgatgcccgcgccgccgccggtgaccagcacggtcttgccgttgaatgaaatcatcgatgaactcctttgaacgggagagcagtgcgtcgcgtcacagcgacgacaccagttgtgcgttgtcgatccgcagctccgcgccgttcacgaaacgcgaatcgtcggacgcgaggaacagcacgagattcgcaacgtcccgcgggtcgcacatgcgtgccatcggatcgctgccgatgccgagcgcggccgggtcgagatcgggcatcagcgcctgcgtcatcggcgtccagatcccgtccggatggatcgagttgcagcggatgcggtaaccgctgcgcttgcaatgcacggcgacgctgcgcgcgagcgccgtcactgcgcctttcgacccggtgtatgcgcacatcatcggcagcccgccgagcgcggcgaccgacgacatcatcacgatcgagcccggcgtgtcgttgcccttcatcgcgccgatcgcatatttgcagccgaggaaatagccgtcggcgttggtgcgcatcacgcgccgccacgtgtcgaggctcgtgtcctcgatcgagccgaccgggcagatcgccgcgttgttgacgagcacgtcgaggcggccgaaacggtcgagcgtcgatgcgatcgcctgtcgccagccgtcctcgtcggcgatgtcgtggcggacgaacagtgcggcgtcgccgatctcgcgtgcgagcgcgcggcctgcgtcctcgtcgatgtcggtcagcacgacacgcgcgccttcggcggcgagcagcagcgcatccgcgcggccgacgccgcttgccgcaccggtgaccagcgcgaccttgtttgcgactcgattcatggtcggtcgtattcccttgacgttgaaagagggcgggcgctcatgcggcgcccggtgcgcggccggccttgatcgcgtcgagcgcggccgtgccgtagatctgcgcgatcgtgtcgtcgacgcgcgggttggtgcgcagttcgtggccgccgtcgaccgcgaaactctggccggtcacccagcccgactcggggcccgcgagatagcgcaccgcatgcgcgatcgcttccggttcgccgagcgtgccgagcgggatctgctcgagaaagctatcgacgagcgcgcggttgtcgaacatcggcgccgttgcttcggagcgcgtgaggcccgggcgcaccgcgttcacgcggatcttcgcgccggccagttcctcggccgcgccgcgcacgagcgcttcgagcgcagccttcgcggtgcagtacgcggacagccagcggaaattgatccgcgcggccgtcgacgagatgcagacgatcgcgccgccgccgctgtcggcaagccgcggcgcggcgtggcggatcgcggcgaacgcgctgtgcaggttcaggtcgatttcggcgcggaaggtgtcggcgtcgtgcagcagcagcggccggaaacccgcaccgccaaccgtcggcacgacgatgtcgaggcgacggtcgagcgcccacgcgcagtcgagtgcggcctgcaggtcgccttcgtcgcaggcgtcgcccgcattgatcgcgacgcggctgccgggcaccgcgtcggtcagttgccgttgcgtgcgttcgagcgcgtcgcggcggcgacccatcagcacgacggccgcgccgtcggcgacgagcgcgtgcgcgcaggccgcgccgatgccgccggcgccgcccgtgacgagtgcggtgcggccgtcgagggagcagcggtgcgcatcgttcagccctccagcggcaggtcttgcgaccagtcgacgtgcagcgtgcgcgcggcgaaacgccacgtgccgccgtcgaacacgcagcggtcgcgatagcgcagccccagtcgagcttgcgcttcacgccgtcgcgcacgtagacgtggcaggcgacgccataggtctcgacgtcggcctcgccgccgtcgagcgtcacgagctggttgtgcacgtgatgctgggtcgcttcgtagcgctcgatcacgcgcatgcccgtcacgatcgcgtcgcgatcgtcgaagcggaagccggggccggcgagctgtgcatcgggcgtgaagagggcggtgagtcgcggccagtcgcgccggtcgacggcttgcgcatagcggcacgccagttcgtacagcgcgtggcggggattcgaatcggtcatgcagtgctcccgtggaagaacggaaagagtcggccgcgccgcgagtgcggacgcggcggcattgcgacgtcgaggcgaaggttcgcatcggaccgatggcgactcatcatccatacggagcagggcgagggtcggggaaaacaccggggccgggtgccgcgtgccgcacgatcgcgcaatgttggtgcggcgcagcgaccggcgtgcgacaggcgtctgacgattggcgcggccggccgtgacaggcgcgcaacgcgccgcgtctcctccgcgtgcgcgaagccatcgcgcacgatgctgcgatgcgacacgccgtgcgcccgccgctcagcgtttgcccctagtcgaaatggacgatggccggcggccgggcggtggctaccgtgcagtcatccggtgccgcatgcgatgcacgccggacacgaaccgcaccagcggacaaccggagggacgacgatcatgagactgacgactcgcaagctgtgcgtactggcgatgggcacgttcgctgccatggcgatggcgcgatacggcgccgatcaggttccgtcgccgccgtatgcggccggcatcctgcaatgccgctcggtcgacgcgaacgggctgccggccggctgcgtgccgatcgatccgtcgcacttcggtttcgccgcgctgcgcggcatgtgacgtcggcgcggctgcgcgccgcgcaggccggaagccgtggcggcgcgatggcgtaccaatgcccttcgccacgaccacgtcggaatcatcgcgcgggccgatccgtttgacgcgcatcgcggcttcaaccgggcgcgggacgcgtgcgtcgcgcacacgcaccgtcgcacgcccgtcccggcaacgtcggcgaagggcctcgtgtcaggccctcgccgcatccaccgctttccatcgcttccctcaggtttcctacacgctgacccattcctcatgtcatccgactattccctgactcacccctgaacattcgcgacgtgcatcgctgggatgccgaacacgatgtcgtgatcgtcggcttcggcgcggccggcgcctgtgctgctatcgaagccgcgcgcgccggcgccgacacgctgatcgtcgagcgcgcatcgagctacggcggcacgagcgcgctgtcgggcggcgagatctacctcggcggcagcggcggtacgcccgcacagcggcaggccggctttaccgacgacaccgaggatctgtaccgctacctgatgctggccggcgggcgcgacgccgacgaggcgagggtgcggctctacgcgaacgaaagcctggcgcaccacgactggctcgtcgcgcagggcctcacgtacaagaacacgttcattgccgagcggatcgtcgaaccggagaccgacgattgcctgatctggtcgggcagcgaggaagcctggccgttcagcgaggccgcgaagccgtgcccgcgcgggcacacgccgcaatggccgggctggggcggcgggcagatgctgatgcgggtgctggccgaacgcgtggcggcgctcggcgtcgcgacgcgttacgacacgcgcgcgctcgccttgatcgtcgacgacgacggcgcggtgcgcggcgtcgtgctgcgcgcgtatggcgagacggcatgcgtgcgtgcgcgtcgcgcggtgatcctgtgcgcgggcggtttcgcgatgaatcgcgacatggtgcgccgccatgcgccgcagttcctgcgctcggatgaaccgatcggcagccccggcgacgacggctcgggcatcctgctcggccagagcgcgggcggcgcggcgatccacatggaccagggcttcgtcagcctgccgttctatgcacccgaatcgctgatccgggaatcttcgtgaacgcgcgcggccagcgcttcatcaacgaggacggttatcacggccgcacgggccatcacgcgttccaccaggccggcgaccgtatctacctgctcgtcgaccaggcgacgtaccgcgagccgcccgcgattgcgcggatcggcatcgcggcggccggcgaaacgtgggaggaagtcgaacgcgacctggagatgccggccggcacgctgacggcgaccgtcgacgtctacaaccgccatgctgccgaaggcgccgatccgctgttccacaaggccgagaaatggctgcagccgctgatcgagccgccgttcgtcgcgctcgattgccggatcgactacgcgttctatccgcacttcacgctcggcgggctcgacacgctgccgaccgggcaggtggtcgacgcggcgcgcgcgccggtgccggggctctatgcggccggccgcacgacctgcgggctgccgcgctggggcgccgggtacagctcgggctgtcgctggccgacgcgacgtttttcggccggcaggctgggcgtcacgccgcgcaggcgggtgcgacgcgctgcgcaacgccgcgtagcgttggcagggtggaaatgaacgacgccccgggcaatcgtattgcccgggcgtcgtcgtttcgggcaccgaagtgcccaagtgcttgagcggcccagcggctcagccgctaagcggccaaccaggcccgcccgccgtcaaccgaggtcgagcgcgttcgtgagatcgcccggcggcgtcgcgccgcgcgcagcgaacgccttgttgcgcgcgaccacgccgtcgagcggcgcgagcccgtgcacgcggctgatgaagcgcaggatcgagttcgtgtcgtacagcgtgtgatcgacgaaacccttcttcgcgaacggcgagatcacgagcgccggaatccgcgaaccggggccccagcggtcgcccaccggcggcgcgacgtgatcccaccagccgccgttctcgtcgtgcgtcatcacgatcacggtgttgtcccattgcggcccgcgccggatatggtcgatcaccgtcgcgatgtgacggtcgccggattcgatgtccgcgtagcccgcatgcatgttcaggttgccctgcggcttgtagaacgtgacggccggcaggcggcccgcgtcgatgtcggcgatgaagtggttggtcgacggctcgtcgccgagcccggcgtcgcgcaggtgcttgctgcgtgcatcggtgccgggcgcgtagttcgcgaaatagttgaacggctggtggtggtactggaaatcgggcacggcgcccgtgtcgcgatgctcgagcgcgtattgccacgcgccgctgtaccacgcccagtcgatgttcttttccgacaggcggtcgccgatcgtcgcatagccctgcggcggcattacgcgatggtcggccgggtccgcatacgcggcgttgcccggatccggcggcggcacgtagctcggctggtacggcggcgccatcgtgttcacgccatagccgtccggcgtcagcgggccgtcgcccgcgaacttcggcgggccgtcgagcgcggacgcgggcgaatcgtcggcgagcttcaggcgcgtgccggccggatcgtcgccttcgaccttcgacagcagtttcgccgcatgcggatgcttgtgcgcgtccggatacagcggcggctgcgcggagatcaggaacatgtggttcatccacgaaccgccgaaggccgccatgaagaagttgtcgcacagcgtgtactgccgcgcgaggttccacagccgcagcgtgtcggccgaattgcggtaatggcccatcacgaggccgcccgaatcggcccatgcggcgaactggtcgttgcggccgcccgcgatctgcatctggttctggtagaagcggtgccacaggtcgcgcgtgatcacgccgttcggcagcggcttgccctgcgcgtccgcgatccggaacggcgcattcggcagcttgtcgatgtcgcgctcggcgatcgcgtagcgcttgccgtccacttcctgcgcctgcggcacgagcccgccccagatcttcggcagcacgggcaacggcgtcttgccgtcgcgatcgagctgctgcgcgtgctcgggccgcacctcgctcagcggatggcttacgcccgggaaatcgccgtacaggttcgcgaaactgcggttttccgcatagatcacgacgatgtgccgcacacgctggcgcaacgcctcgtcgacgcgcaggtcggcggcggaacgcggcgcgccggtggtttcacagccgctgagcgcgacacccgcaccgagcgcggcaaggccgccgagcacgcggcggcggtcgggatcggcgggaaggtcgtcggggcgatcggggtgtcgttcacgtcgtgggttcctcgaatgggcgggtggacggggcgtgatgcacggcggtgccgcacaggctgccgtgccgcaggatggagggcaacggcccgtgtggggtatcggcgcgtgcgatgcgtttgtcacaaagtgtcacgaacgcgactataacgcggcaacgggggcggatgaaaggtgtttgtcggacgattcccgtcgcgccgcgggcaatgcgcgacgcactcgcgcgaactagacttgattcagggcggcgcgtcgtgacgtgccgcccgggcgaggattgcccggcgatgccggccgacggcgttgtcgcggcatcgttgatgcgcaggagcgaggcgagatggcacgcatgtataccgctgccgcatggccgccgatgccgcgcgcgggctgcgcgcgtagccacgcacgtccgccgtgccgcggcagcgcagcgtagcgccgcgcgcacgtccggccggatgccatggacaggaaattcgactacccgggattgctgatcgccgcgggcttcttcgtgctgttcgccgcgcagttgctgatgctgcgtccgtcgtcggcgtcgatcgcgtacagcgatttccaccggctcgtcgccgcacggctcgtcgacgatctcgaagtcagccccgcatcgatctcgggcacgctgaagatgccgcaggccggcgcgatgctgccggcgtccgacgcctcggccgtgcagcaggccggtgcgccgtggcggttcacgaccaatcgcgtgagcgacgaacacctgaccgacacgctgaccgcggccggcatccgctatcacggcgcgcccgacacgagctggatggcatcgcttgcctcgtggctgctgccgctcgtgctgttcgtgttcatctggaacatgatgctgcgcaagcgcggcgggctgcaggatttcaccgggatgggcaagagccgcgcgcgcgtgtacgtgcagcaggaaaccggcatcacgttcgacgatatcgcgggcatcgacgaagccaaggccgagctgcagcagctcgtcgcgttcctgcgcaaccccgaccgctaccagcggctcggcggcaagattccgaagggcgtgctcgtcgtcggcgcgccgggcaccggcaagacgctgctcgcgcgcgcggtggccggcgaggcggccgtgccgttcttctcgatcagcggctcggcgttcgtcgagatgttcgtcggcgtcggcgcggcgcgcgtgcgcgacctgttcgagcaggcgcagcagaaggcgccgtgcatcgtgttcgtcgacgagctcgacgcgctcggcaaggtgcgcggcgtcggcccgatgtcgggcaacgacgagcgcgagcagacgctcaaccagttgctcgtcgagatggacggcttccaggccggctccggcgtgatcatcatggccgcgacgaaccggccggagatcctcgatcccgcgctgctgcggccgggccgcttcgatcgccacatcgcgatcgaccggcccgacgtgaacggccgccggcagattctcggcgtgcatgtgaagcgcgtgaagctcgcggccgacgtcgatctcggcgagctggcatcgcgcacgccgggcttcgtcggtgccgatctcgcgaacgtcgtcaacgaggccgcgctgcatgcggccgaactcggcaagccggcgatcgggatggccgacttcgacgaggcgatcgatcgcgcgctgacgggcctcgaacgcaagagccgcgtgatgaacgcgcaggagaagctgaccatcgcgtatcacgaggccggccatgcgctcgtcgcggaaagccgcgcgcattgcgatccggtgaagaaggtgtcgatcattccgcgcggcgtggcggcgctcggctatacgcagcaggtgccgacggaggatcgctacgtgttgcgcaggagcgaactgctcgaccggatcgatgccttgctcggcgggcgcgttgcggaggaactcgtgttcggcgacgtgtcgacgggcgcgcagaacgatctcgaacgcgcgaccgcgatggcgcgccacatggtcatgcagtacgggatgagcgagaagatcgggctcgcgacgttcgacgacggcgatgtgcgccagggcatgcccggcgcgtggcatgcgggcgacgggcgctgcagcgagcacaccgcgcggatgatcgacgacgaggtgcgcacgctgctcgccgacgcgcatgcgcgggtcgcgatgacgctcggcgaacgccgcgatgcgctcgaacgcatcgcgcgacggctgctgcaatccgaggtgctcgagcgcgaagcgctgcaggcgctgatcgacgggcgcgtcgaaccggcctccgcggcgccggctgcaccggcaccggacgacgaagacggcgcacgcggcggcgcgatcgaaacggagcacgcgtccgcggtcgagcgcgatttcgtcgcatacgggccgccacgcgagcccgagcgctgaaggtgccgcgaacctgcgggcggcgcgcatcgatgcgactgcgtgccggcattcctttcccagttgatctgcgcggagtcgccatgagcgaggcgcacatatcggtcgatgtcgcgcagcaggcgcgcttctgtttcgaagtggtgtttgccggcacgacgctgtcgccggtcctcaccgacgaaccgccgccgctcggcgaaggacgcgggccgaacccgatccggttgctggccgcggcggtcgcgacctgtctcgcggcgagcctgctgttcgcgctggaaaagcagcatgtcgatccgcagccgattgccgcacgcatcgatgtcgacatggtgcagaacgaagcgggcagggtgcgcgtgggtgcgatgtcggtacggctgtcgatcggcaggacgtgggccgatctcgcggcggcgacgcgcgtgctcgatcagttcgatgcgtattgcgtgctgacggagagcctgcgagaaggcattccggtgtcggtcgacctgtgcgatgtgagcggcgcggtgctcggatacgcggcgacggacgcgtgagcgcgcgtcagggttcggtcgcggccgcgacttcggccgcttcggcgagcgcgtcgagaaagcgcgtgcgccaccagtgcacgtcgctcttgcgcaagatcgccatcagcgccgcatgacgctggcgacgctcctcgagcggcatcgcaagcgcacgctggatcgcctgcgcggtgccttgcgtgtcgtacggattgacgagcagcgccgacttcagctgctcggccgcgccggcaaaacgcgacagcacgagcacgcccggatcggccgcgtcctgcgcggcgagaaattctttcgcgacgaggttcatcccgtcgcgcagcggcgtaacgagcgcgacgcggctcgcgcgatagaggcccggcaagcgcttgcgcgcgacggtgcggtgaatgtagcgcatcggcatccattcgagttcgccgtagtcgccgttgatcgcgccgcacaggctgtccatctcgcgccgcaggtcgtcgtatgcgccgagattctcgcggctcggcgcggcgatctggatcagcgtcgcgcggtcgcggttctccggatactgttcgagcaactcgcggaacgcatgcacgcgctgcggcagccctttcgtgtaatcgagccggtcgacgccgaccagcaactggcgccgcgaatattcgtcgcgcatccgctcgaacatgtcgaggccgtcgcggtcgcgcgcgagcgcctcgaactcgtcgacgttgatgccgatcgggaacgcgcccgccgacagcgtgcggccgaatgcacgcagccggccgtccggcagccgcgcggcgccggcttccgcttcgacgtaatgctcgaagtggagcaggtccgactcggtctggaagccgacgagatcgtatgcgaacagcgagcgcatcagccattcgtgttccgggatcgcggccatgatcggcggcggcggcatcgggatgtgcaggaagaaaccgatcggattcgtacagcccatcgcgcgcagctcggcggcgagcggaatcagctggtagtcgtggacccagatggtgtcgtcgggacgcagcagcgtgcgcagcttgcgcgcgaacagctggttcacgcgccggtagccgtcggcgaagcggcggtcgaactgcgcgagatcgagccggtagtgaaacaccggccacagcacgttgttcgaataaccgaggtagtaggcgtcgtagtcctgcgggtcgagatcgatcgtcgcgagctggatgccgccgacgttctggatctgcacgtcgtcgccatgcgcgggctggtcgtcgctgccgcgcagccttccgctccagccgaaccagacgccgccggattcctgcaggctgtctttaacggcaacggcgagcccgccggccgcggctttacggggatctgcaatgcgattggatacgacgacgagtcggctcaccagctctcctgacgattgttggggaaggttcgtgcggccgtggcgcgagaagcggacgccgccatcggcacgcggtgtgcgaagcgatggggccgcaatacgatcggacgggagtcagggcacgcgattcgccgtccgaacgcggagtgctttttaagcatactcgtcattcgttcgttttaaaagtctgcgtcggcgagcgatgcgcgagcgaacgctgcgttatctccatgtcgccggtgtggcaacacgcgatacatggccgggatcgaaacttgcgcaacgctgcaaacgcggcgtgcgcgatggcatgcggaggacgggcatcgcgcgcgatcgtccgtgacgatgcggattgccggacacgcgcacgatgccgcgccggtcggtagaaacgactggcgacgacgcggctacgccgacgggcgagctacacgcacgcgtgccgcgaatcggagaggagacgcgcgacggcgcgcgtgcgaacggttcgaaccggacggcggcgatgcgcagcgcatcgcgcggtatgcgaaagcgtgacgcaggcagattggcgaaaccgcgtgcgcatcgtcgtctccttgcggtatccgtcacgcggcggccggttgccagcgatgcgcggcgggttcctgcgcgcgcgcgccgacgacgtcacgtgcgtgcccgacggcatccggaacgcggcgaccgtttcggacagctcgcgaccttgcgcctcgagcgacttcgatgcggccgcggcctgctcgacgagcgccgcgttctgctgggtcgtctcgtccatctgcgtgatcgtcaggttcacctggtcgatgccgcggctctgctcggccgacgcggccgcgatctcgcccatgatgtcggtcacgcgcgcgacggcctgcgtgacgtccgacatcgtcttgccggcttcgccggccagcgccgagccgtcgcggatcgtctgcaccgacgcgttgatcagttccttgatctcctttgccgccgtcgacgagcgttgcgcgagactgcgcacctcgctcgccacgaccgcgaagccgcggccctgttcgcccgcccgagccgcttcgacggccgcattcagcgcgaggatgttggtctggaacgcgatgccttcgatgatgcccgtgatgtcggcgatcttcgacgagctatggccgatttccgtcatcgtgtcgaccacgcggccgaccaccgagctgccgcgatgcgcgacatccgacgcattcgcggcgagcgcgctcgcctgttgcgcgttctcggcattcagccgcaccgtcgacgtgaattcctccatcgtcgcggcggtttcctgcagcgacgcggcctgttcctcggtgcgctggctcaggtcgaggttgcccgacgcgatctcgctcacggcatgcgcgatgctgttcgatgaatcgcgcacacggccgacgatgccgatcaaccgctcgttcatcgtccgcagcgcttcgagcaggtcgcgggtctcgtcgttgccgctgacgtggatgcggctgccgagatcgccgttcgcgaccgtgcgcgcgacgtccacggccgagccgatcggcaccgtgatcttgcgtgtcagccacaggccgccgcaggccgcgaccgcgaccgcgatcaggcagataccggccagcaggttgcgctccatcgcataacgatccgcgaattgctgggcgatcgcgagttcgcgttcatgcgtatagcttgcgtaggcatcggtcgcgcgcacgagctgcgcgagcagcgggcggcagttgtcgtcgatgtcggcggtcgcctcttctttcttgccggcttgcgcgagcccgacgatacgcagcgcgacgggcccgtagctggattcgatgcgggcgatgttgcccaccagttcgcgcgcgcgatcggaggtgtcggtcgcgttcgccatcatctccttgagcttcgcgagatgctcctgcacgtccttgtgcgcctggttcacctcggccagttcgagctcgagatcggacggtttggtcacgagcacgatgttgcgcgccgcgatcgcgcgccggtcgaccgcggttcggatttgcgcggactggttcgcccgcgcgttgatgccgttcatgtagcgggaaaactcggcgttcgtatcggagagtgccttgagtgccacgcccgacacgatcacgacgaccgcggcgagcaggccgaagccgccaaggagttttgtcttgatgctcattctggcgatattcacgttgtgcccctgcgcgtgtggttggcaaattgaatttattgttcgaccagatacgggctcgtgccggcattaacgggtataccgaatgattctttacccttcgaaaaccctgatattagtttttagcgctggaatccttttcgggcgggtttgctggaacccgatcagacagagtcgaggcgcccgtgattcaaaggtttatacgtggaatttgaaaccggttttaccgggcgaggcaaaggagatcttttgctaataatcgtctgatgaatttgtttttatttatgggtgaataaagtggaattcccttgcgccctgattgggagggaaccggtgcgcgtcgtcggtatgtgtcgcgcgatgggcggtaatgtccggaaagcggaaattcgcgacggagcgggggcgccgcaaagcggcccgcggcgggcgccgcgggccatgagagggtcagaacgtggtgcgcaacccggccatcacgctgcggccgccttccggcgcgaggccgcgtacgaccgaggtcgaatagcggatttcctggttcgtcaggttgtcgccgcgcaggtacgcgagccagtgcgtcgcaccgacgcggaacttgtaggtcagcatcacgccgagcgacgtgtagccgtccgtcgaaaagtcgttgtcgggcacgcgatgctgcgaccacgcatgcgtgacctgcgcgcgcgcaccgaacgggccgtagccgtagtcggccgcgagcgtcgcgcgcagcggcgcgatgcgcggcagcggctggcccgtatcgacgttgcgtgcgtgcgtgtagtcggccgtcagctccaggtcgaccgtatggccgcgccgcgcgaaggcgcgccacttgccgtccagctcgatgccgtagaactcggcgcgcacgccacggtagatcgcctcgttgagcgagccgtcggtaccgggcgcgaccggttcgccgtcgtcgtccacgacgcggcccgtgttgtactcggtcaggtagttcgagaagcggttgtagaacacgccgacgctgccgcgattcggcccgctcgcgtagcgcagcgacaggtcggtcgacacggccttttccttcgacgcgttcgggttgccgatcaggaactggccggtcgcatcgtgcgggccgttcgaatacagctcgtagaaggtcggcgcacgttcggtgtatgcgacgttggccgccaccgaccacacgggcgtcagcgagaacagcgcgccggccgagacgctgccggcattgaagtcgcgcggctgcgctcccgcgaatttctcgacgccggccggatcgggatcgaccttcacgtgctcgaagcgcccgccgacgctcagcttgagcgccgggacgacctgccattcctcgaggccgaacagtgcgacgctgttcgtgcgcgtggacggcacgagcaattcgtcaccgagcgccgagaacgtgttctggccgaactgcacgccgatcgcgccttcgaacgggccgatcctgcgatgccgcgcctcgatgcgcgcctcgtagccgcggttgcggaaggtggtggccgtctcgccgttgtcgacttccttgtggcgatagtcggtgtacgcgaagtcgaatttcagcttcgtgaacggcccgctcaggttgcgtatttcggaggcgagcgcgagccgttcctggcgcatccgcaggcgcacgtcgtcctcggcgacggagccgtagttcgactcgtagccgctgtacgacaggcccgcgaaaccgtctgcccacgtgtacgacgcaccgaccgcgccgccatgcacgcggccgtcgctgttcggcacgttgccgtacggttgcggcgtgtcggggccgtcgatcgcgcgttgctggctgctgcgcgcatagccgggaatccgcagcttgctcgtttcgcggtcgaacgcgtcgacatggaacgcgaagcggccgttgccgccttcgacctgcgcggcgcccgcgcgcaccgaattggcgccgccgtagcgcgcgtcgagcgcgcccgtcacgccttcgatcgcctcgcgcggaatccggttgtcgatcgtgttgacgacgccgcccacagcattgccgccgtacagcagcgcggccggcccgcgcacgatttcgacgcgctcgatcgacagcggatcctgcggcaccgcatggtcgtacgacagcgacgacgcgtcgtaggccgcgacgccgttctgcagccggatccggtcgccgtccatcccgcggatgatcgggcggccgaccatcggcccgtaggtggtggtcgacacgccgggcagcccgttcagcgtctcgccgagcgaatcggcctggcggcgcgtcagcgcgtcgccggacagttgcgcggtcggcgagatcaggtcggtgtcgccgagcgggttcgcggtcacgaagatcggcgcgagcgcagtggtttgcgtcggtgcagacgaggcgggcgtatcggcctgcgcgtgcgcgacagcggcgaacagcatcagcgagacgggcgagagcgggcgaagcggtagacgaggaggtcgcgcatggtcggtgaatcaattggaatgggttggaatccgatcggaaggcgagccatgcgggtcacggctggatacgatatattgttgcgtctgcggcgcgcagtgacccgtctggatatgactcggcgtaacccggccaccgggatgaaacggcttcaggtgggcgagaacgcaaaatgatatgttatatcatttcaaattccaagcaaaacggcggcctgccacagggtttccgacaaacggctgaaatggctgcgaaagcagaggcgggccgtcgatccggcggcgcagcggcggcttgcgcgacacgtcccgccatgaatccgccaccggcgcgcacgattcctgccccgttgacgcgtatcaatgcgttccgggttcgagcccggatactggtgcgctcatcgaccagacaggagcgacgcatgactcaaaccatgaaagcggccgtggtgcacgcgttcggcgagccgttgcgcatcgaggaagtgccgatcccgacgccgggccccggccagatcctcgtcaacatcaaggcgtcgggcgtctgccataccgacctgcacgcagccgacggcgactggcccgtgaagccgtcgctgccgttcattcccggacacgaaggcgtgggcgtcgtcgcggcggtcggcgcgggcgtcacgcacgtgcgcgagggcgaccgcgtcggcgtgccctggctctacacggcatgcggccactgcgagtactgtcacaccggctgggaaaccctctgccacgggcagcagaacaccggctattcggtcaacggcagctatgcggaatacgtgctggccgatcccgattacgtcggccatctgccggcgcaggtcgcgttcgacgagatcgcgccgatcctgtgcgcgggcgtgaccgtctacaagggcattcgcgtcaccgatacgcgtccgggccagtggctcgcgatctccggcatcggcgggctcgggcacgtggccgtgcaatacgcgcgcgcgatgggcctgcacgtcgcggccgtcgacatctcgcccgacaagctcgcactcgcgcgcgagctgggcgcgcagctgacgatcgatgcgtcgatcgacgatcccgcgaaagtgatccagaaggaaatcggcggcgcgcacggcgtgctcgtcacggccgtgtcgcgcagtgcgttcgcgcaggcgctcgggatggtgcggcgcggcggcacggtggccctcaacggtttgccgccgggcgatttcccgctgccgatcttctcgagcgtgctgaacggcatcacggtgcgcgggtcgatcgtcggcacgcggcgcgacctgcaggagtcgctcgatttcgcggcggacgggctggtgcgcgcgcatatccatcgcgaccggctcggcaacatcaacgacatattcgcgcggctgcgcgaagggaaagtcgacggtcgcatcgtgctcaccgacatgcactgacgcgcattcgggcccgctgccgcgacgcgacggacgccgcggcagcgctgcgctcacgcgtgcatcacggcgcgaagaacacgtcggtgcggttcgtcaggttgcccgcgctggtctgcacgaagaacgggtggaacgacgacgaaggcattacgtcgagcccctggtagtcgccgatgaagaagccttccgcgttcggcgcgagcttcatgtcgaacgggccgccgacgcgccgctcgtcggcgaacgtcgtgccgccgtcatgcgagatcttgcgccagaaaccggtcggcagcgtcgtcgtgttgccggcctgcaggtcgcggaagtcgtagtaggtgaccatcacggcgcccgtgttgtcgacgcgcaccgacggattgaacgcggggcgcccggtcggcgtgttcaactgctgcggcgtgctccacgtcgcgccgccgtccttcgacgtcgatacggcgatctcgtcgtacgtgccgccgttgaagcggctgtcctgccacaccacgtagagctgccccgatgccggatcgatcgcgggttccggaatgatgtcgccggtgcgcacgggctcgccggtgttcggatcggtgacgccgaccgtctgcagccccgcgatcacctgcggcttcgtccacgtcgcgccgtcgtcggtcgacttgatgaacgcgaccttgccggctgccttgctgaacggcggctggatcaggtcgaagaagtcgtagagcgtgccgcttttcggatcgacgacgatctggttgccgatcgtctgctgacgcgacggtacgttgacgatcaccttcgcggcgctccacgtcttgccgccgtcggtcgtcttcgagaacagcgtcggcccgcggtatgcgtgcgtgtgcaggttcgcgtacgggttgccgttcggcagctcgaggcggtcccacaccgcgtaggccgtgccggccttcaccgggttcgccgtcaccgattccttgtcgttgaagaactgcgtcgtcggttcgtcgttcgcgatcagcacggccgggctgctccaggtctgcccgccgtcggtcgacaccgacgcggccaccgcgttggcattgttcgactggttgaaggagatcgataccgaatacgcggtgccgtccggcccgaacgatacccacggatcggacgcgcgctcgtacttcagcccgcccggcgcgcatgcgctgaacggctgcggcgtgcgggcccaggtcgcgcccgcgtcgaacgtgtagcccgcgacgagcccgtgggcgccgccgttcgaccagcggtcctgctgccacacgccgatcatgttcatcgggttcgccgggttgaccgacagccacggttcgacctcggcattcacgtagttcgtgccggggccgccgatggtgcaggcggcgaacgggctcgggccggacacgaccacgggttcggcatgcgcggccgcggcggcggccattgccacggttgtcgcggcggacaggcgggtgaggcgggtcaggccggtgataagcgagtgggatacggtcgaacgtcgcatggactgctcctcgttgacgtgcggcggcgatggcgcggagcggcacgtcgcgtaccggtacgcggcggcaacggatgccgtgccgcgcgtcggatcgtgtcgttcaggaagccgtttcggtcatcgcaatccgcgtgtgctggatgccgccagcacgtcggtcaagacacctcttggttttcattgcttgtcgggtgcgtccagggaggcggacgcgacgggaaggccagtccgtgcatacggcgaatgcgtcgaagtggattgaatgtaggcgatcggtatgcggcgcgggaggcaatttttgtaacagtacgtagccggaaagcgttgccgaaacagcgcttccgggacgcaagaatttccgccggaaagttcggaaaccgaatcgaaagcacgaatcggaatcgctatcgattacgcggattcgtgccgatgcagtgcgcggtcggcgcggttcagcgttcggccggaaagcgatcctgcaacgcgtgcagccagcgcgcgacgacgtcgagttcggcgtcggaaaacccgtcgcacagcttgccgttcagctcgcgcagcagcacgcgcgcgcttgagcgccgcttggccgtcgtcggtcaggtacagccgcgttgcgcggccgtcgtccgaatcggcgtgacgcgtgatgaggccggcctttgccatgcggtcggcgaggcccgtcatcgcggacggcgcgagctgcagcgcggcgccgacttcgccgatcagcgcgccgtcctgcttcgcgagacagaacagtgcaccggcctgcgcggcgctcgcgcgcgtctcggtttcggccttgcggtcgatccagcgctgcacgcgccgctggccgatgttcaacatgaaaaacagtcgtcggtcttcgctcaagctgggttcccggctgcaatggaaaggagggacggcccgcggtgcgtggtgcgtcgagtgcccgcgcgagccagtcggccacgtcgggccacagcacggtgccgggccgactgcgaaagaagcccatgtgcccgaccgggccgctgcccgccgcgcgcggatcgatctggcggcgttcgacctgcgcgcgggtcagatagcttaccagcaggccgatcgcggccgggttcgcccacggatcgtcgtcgaagccaagcgcgagaatcggcaaccgttgcttcgcgaagcgctcggccgcgccgagcgtcggatcgtcgaagaaatagtgcggcagcgtcgtccagcggctccattcgcggaacacgccggccggcatgtcttcgccgagcccgagccgcctgccgggcacgtagccgagcagcgccgacatcagcggaccgagcacacgcaggatcagccgcaccttcacgcgttcggccgcctgcgtgatcagtcgcgtgctgcccgcatgcgcggcgacgagcacggccgcgcgcaggtgcggcgtggcggcggacagcccgatcgcgtgcccgccgacgctgtgcccgaccgccagcagcggcacccttcataggcctgccgtgcccacgcggtcgcggcacccacgtcgagctccatccagtcgcgcatgcgggcccgcagcgcacccaggcgcgcgggccgcgatgcaccgatgccgcgatagttgtaggtgagcaccgcgaaaccgcgcccggtcaggaaacgtgcgaagcccgcatacagccgctccggcacggccgtcgccggatggatcagcaccagcgcgcgcggcgccgcgtccggcgtccacagcgtgccgtgcaacgcgtagccgtcggcggcggaaaactcgatgggttgggaggtcatggccgtcctcgttccggatggttatttcgtatgcgaaatataatccgggatttatttcgtgcacgaaatatctgtcgaggattcattcgaaccgggttcccggacgggcggcgggcggcatctggcgataccggccacgtcataaaacatttgcatctttgcatagaagaatattgcgtttgtttcatggtgcggatcgacgtatcttcaccggttccatccgttccgccggccgccgggcatggcggaacacgtggcgccgccatcgcgcgggcgcccgccaaccttcagggagatcacgttgctgagccgaatcgtcacggcactcttgctggcgcttgccgcgcagccaggcatggccaaagacaccgtcacgctgcgcgtcggtgaacagaactacttcaacatccaggcgtcgatggaggcgtccggcgtgctgaaggacctgccttacacgatcgagtggaagcacttccaggccgccgcgcccgtcgccgaaagcctgaacggcaatgcgatcgacgtcggcttcctcggcgattccgcgctgctcacgctggccgcgcgcgcgcggtgaaagtcgtcgcggtgtcgcggcagagcctcgacggcgttgcgatcctcgtgccgaagaactcgccggtgcgcaccgtcgccgacctgcagggcaagaccattgccgtctggcgcggtgcgtggagccagcagctcgtgctgcgcgcgctcgaacacgccggcctgcgcgcggattccgtcaagtacgcgtacctgatgccgatcgatgcgaccaacgcgctcgcgaacggctcggtcgacgccgtgtcgctgtgggagccgttcgtcagcacgctcgcgctgcggcagggcgcacggcccgtgacgaccgcgcaggggctgatgcccgcgctgagcttcgtcgccgcgaacgagcaggccgcaacgggcaagcgcgccgagatcaccgatttcctgaagcgcgtggtggccgcgcgccaatgggtcgacagccatccgcgcgagtatgccgacctgtgggcgaagcgcgcgaagctcgagccggacgtcgcgtaccgctggctcaacaatgcgcaccagcgcgtgggccccgtcgatgacacggccgcgaaggatgcgcagaacaccgccgacttcctgcacaaggccggcgtgattccgaccgcgtacgacacggcgaagctgctcgaccgctcgtatgcgggcgcgttcgccgcgcccgcgcagaagacggccgccgcgcagtaagcatgccgcaacgcgcagccatttccgatcgacaacgagaaggaccatcgacatgcccgtcgacatcatcggcatgatcaccgcgacgcccggcgcggaggtcgacgtaccgggcggcgccgccgtccagcccgactacgtgcgccgcttcgcgcaggcgcacgaggccgccggcttcgaccagatcctggtcggccatttcagcaacgcggcggacggcttcatcgtcgcgtcgttcgcggccgccgcgaccgaacgcatccgcatcctgctcgcgcatcggccgggcgtgatcgtgccgtcggccgccgcgcgccagatcgcgacgctcgacgtgttcagcggcggccggctcgcgctgaacgtcgtgtcgggcggcgacgatgccgatcttcagcgcgacggcgatttcgtgccgcacgacgcgcgctatcgccgcaccggcgagtatctcgacgtgctgaaacggatctggcaggccgacgcgccggtcgaccacgatggcgcgttctaccggttgcgcggcgcgtcgccgctcgtgaagggcgcgcaacggccgcatgtgccgatctatttcggcggctcgtcgccggccgcgctggcggtggcgggcgagcatgccgatgtctacatgacgtggggcgagccgctcgcgtcggtgcgcgagcagatcgcgcgcgtgcatgcggccgccgcgccgttcgggcgtgcgccgcgcatcagcgtgtcgttccggccgatcgtcgccgataccgaggcgaccgcgtgggagaaggccgaggcgatccgcgagcgcgtgcgcgcggcgcggctcgcgaacggccagccgatcgacggccatgcgccgcaaaacgcgggctcgcaacggctgatggccgccgccgcgcagggcgacgtgctcgacgagcggctgtggatgggcgtcgcgaacctgaccggcgcgcgctggaattcgaccgcgctggtcggcacgcccgagcaggtcgcgcgtgcgctcggggcgtattaccggctcggcgtatcgacgttcctgattcgcgggttcgatccgctcgacgatgcgctcgattacgggcgccacctgattccggcgattcatgcgcaggtcgcggagctcgaccgctatcacgcggcggtgtccgcgtaggcgcgtcgcgccgttacgacgcaagggctgcttcgattcgccccggcattcccgttgagggattgccggggcgatgtcattcgggtggtcgacgtatcgatggccttcagaacgacggcaatcccggcggattggtttccgcccgcgcgatcgcctcgctctgcaaaccccagcgcgcgagcgcctgtccgtagcggccgctgccgatcagtgcgttcgtcgccagcgtcagcgcgggcgcgagcccgctgccgcgccgcgtcgcgatcgccacgtcggcgttggccggccagcccgcattgacgacgccgacacggcggatcttgccggtgcgcgcggcctcgtacgcgagcgacgcgttcgggttcagctcggcatcggcgcggcccgacagcagcgcgacgcgcgacgccgcgtcgtcgtcgaaatattgcagctcggccggcttcagcccctgcgccacgttgcgcttgttccactcgagcaggatgcgttcctggctcgtccccgcgcccgtgatgatgcgcaggccggcgatgtccttcggctcggcgatctttgcgatcgggctgccggtgcgcacgtagaagccgtgcagcccgagccggtaggtcgtgaaatcgcatttctccttgcgcttctcggtcacgccgacgttcgagatcaccgcgtcgtacttgccggacgtcagcccgagcggccagtcggcccatgcgatcggcaccagcacgagcgtgcggccgagcgcgtcggcgacgagttgcgcatagtcgggatcggcgccgaccacggtgcgcgcgtcggtcgcgtaggtcgacacgggcggcgcgtgcggtgaaatcgcgaccgtgaatgcgccgtcgcgcacccagcggtagccggctgccgcgcggatcgccgcgtcgtcgcgttcggcacgtacgcggcccgcctggcgcgggtcgaggtcggccgtcgcggcggccgcatgcgccgcgcgccacggcaagcccgctgccgcgaccagcgcggcggtcatgaactggcgtcggtcggtcatcgtgcggcccctcgggaatcggcagcggcgcgcatcacagcacccgcgacaggaacgcgcgcgtgcgcgcatgcgtcggcgcgtcgagcacgacggccggcggcccggattcgacgatgcgcccgcgctccatgaacagcacgttgtccgcgacttcgcgcgcgaagccgatctcgtgcgtgacgatcacgagcgtcgtgcccgagcgcgcgagttccttgatcacgtcgagcacctcgttcacgagttccgggtcgagcgcggaagtcggttcgtcgaacagcagcaccttcgggcgcaacgcgagcgcccgcgcgatcgcgacgcgctgctgctggccgccggagagctggcgcggataggcatcggccttgtccgcgagaccgacgcgagcgagcaacgtgcgggcgatgcgctcggcggcgtcgcgcgtgacgccgccgacggcgaccggtgcctcgatcaggttctcgagcaccgtcaggtgcgggaacaggttgaagttctggaacaccatcccgacggccgtgcgacgtgtcagcacgtcgcgctccttcagctcgtagagcacgtcgccgtcgcggcgatagccgatcagttcgccgtcgatgtcgatgaagccgtcgtcgacgcgttcgagatggttgatcgtgcgcagcagcgtcgacttgcccgagcccgacggcccgacgatcacggtcacgctgccgcgcggcgcgacgaacgagacgttgtcgagcacgcgctgcatgccgaactgcttcgatacgccatgcacggccacttcgccgccggcgcgtggcgcgacggctaccgtatcggcctcgccttcggcgcgcacgagcgaatcatcgcggctggacctgacacgccgccacagcacgccgaggcgcgcgagcgcgaacgtgacgacggacggcggcgggttgcgcagcgcgccgcgcgcatagtggcgctcgacctgcacctggatcgccgacagcacggtcaggatgatcagataccagacggtcgcgaccatcagcagcggaatcacttcgagattgcggcgatagatcacctgcaccgtatagaacagctccggcatcgcgagcacgtagaccatcgacgtgcctttcgcgagcgagatcaggtcgttgaacgcggtcggcaggatcgcgcgcatcgcctgcggcagcacgatccgggtggtctggcggccgcgcggcaggccgagcgcggccgccgcttcgagctgcccctggtcgaccgcgagaatgccgccgcgaatcacttccgcggaaaatgccgcgtggttcagcgtgaggccgagcacggccgcgaggaacgggctgatcaggtcggtggtcggcgtgtcgaaccacacgatattggtgaacggcacgccgagccgcacatgctcgtacaggtagccgaggttgttcaggatcagcagcagcacgatcagcggaatcgagcggaacagccacacgaaggcccacgcgctcgccgacagcagccgcgaacgcgacagccgggccagcgcgacgaacgcgcccagcacgaagccgaacaccgcgccgagcagcgtcagcaccagcgtgcgtgcgagccccgacagcaccggcggcgacaggaaccattcggcgaacaccggccagccccattgcgggttgccgagtatcgaatgcaggacgatcacgatcagcgcgacggcgagcacggtgccggccgtgcgcgaccggtggcgcgcgggcacgatccggaaacgcgtgccggcgtcgcgcgcgccggggaagaaagcggcggcagcgcgccgccgaggtgggtcgtgtcgctcatgtcggtggaaatcctcgaatcggtcgggcggacgcgccgcgcacggcggcgcggcggcgggtgtcaggcgtgcgcttcggccgccgtttcgggcgacgcgtcagggaccgcgtgacggcttgccttgcgcggcaggccgaggtggtcgcgcagcgtcgcgccgggcaggtcgcggctgtagcggccgcgcgcctcgagcgccgggatcacgagctcgacgaaatcgtcgacgccttgcgcctgcaccgcgaagccgagaatgaagccgtcgccggcgcccgcgtcgtgccagcggatcagctcgtcggcgacgtgctcggccgtgccgatgaagttcgggcgcggcgtggcgaccgcgagcgccgtctcgcgcagcgacaggcctttctgtttcgcgtcggccttgatccggtcggtggtcgagcggaagctgttgcggccgagctcgccgagttccggaaacggcgcgtcgagcgcgtactgcgtgaaatcgtggtgatcgaaatagcggcccagataggcgagcgcctcgtcgatcgtcagcaggtcgcggatcgcctggtatttgtcctcggcctcggcggccgtgcggccgacgatcggcccgatgccgggaagaccttcacgtcgctgccttgccggccgtgctcgatcgcgctctgcttcacgcgccgcgtgaacgcggccgtttcgtcgagcgacggcgaatgcgtgaacacggcatccgcgtacttgccggcgagcccgatgccggtgtcggaggagccggcctggaagatcaccggctgcccctgcggggaccgctggatgttcagcgggcccgcgacctggaagaagcggccgtggtggtcgagcgtgtggagcttgtcgcgatcgaagaagcggccggtcgcgcggtcgcgcacgaatgcgtcgtcgtcccagctgtcccacaggccctgcacgacgtcgaggtattcgtcggcgatctcgtagcgcagctcatgatcgggatgcaccttgccgaagttcttcgcggtgccctcgagcggcgtcgtcacgacgttccagcccgcgcgcccgccgctgatcgcatcgagcgacgccagctggcgggcaaccgtgaacggctcgctgtacgacgtcgagatcgtgcccgcgagcccgatcttcttcgtcgcgaccgcgagcgccgacagcacggtcagcggctcgaagcggttcaggaagtgcgggatcgacttctcgttgatgtagaggccgtccgcgacgaacgcgaaggcgatgccggcggcttccgccttgcgggcgatgccgatcgcgaaatcgaggttgatgctcgcgtccggcgggttgctcgggtgccgccatgcgttcatgtggctgcctgcgccttgcagcatcaggccgaaaggaatcgatcgtcgggtcgtcatgggagcgtcacgcgttctggtcagggaagggagcggtcggccgcgagggccgcctgcaacggcgtgctcgacagcgcgccgccgagccattcggccgatgcgagccgcgccgcgtagtcggtcaccggcgaatcgatcacgaacgcgtcgacgtcgagccgccggctcagcgcatcgagcgcgcggtgcacgcgctcgggggtatcggccagcaccgtcgggcgcagctcgtcgatgcggtagtcggacgcgccgctctgccgtgcgaattcggcggccgcctgcgcactggggaggttgaagctttgcccgcccgcgagttgcagcttgaagatcttcagcggcccgatcagttgctcggcctcgtcgcgcgtcggcgcggccaccgcgtacagcgcgaccagcggccgtgtgccgcccgcgctgcggtacgcgtcgagcgagcgttcgatgttcgcgtcgtcgccgttgaaatgccccgcgtagcagaagcgccagccgttgcgcgcggcgagcgtgccgctgtccggcgagccgccgagcaggatgcgttcgggcgcctgcggcggcacaggcagcgcgaccgcgccggcgagcgggtgatcctcggccacgccccagccgagaaacgcgtcgagttccgcgagctggcccgcgaagtccggcttgcgcgccttgtcgtggaaccactgcagtgcgcgcgtggtcagcggcaacccgccgggcgccttgccgacgccgaggtcgacgcggcccggcgcgagcgcagccagtaccttgaacgtctcggcgaccttgaacgggctgtagtgctgcagcatcacgccgcccgagccgacgcggatgcgcgacgtgtgcgcgagcaggtgcgcgacgacgatctccggcgcggagctcgcgaaggcctgcgtgccatgatgctcggcgacccagaagcgctcgtagccgagctgttcggcgcgctgcgcgagcgtcgtggtgaagcgcagcgcgtcggcggcgttcgcgccgtcggcgatcggactcttgtccagcaacgaaagcgagtaagacatggtgggcggcgttcctgcgtgagcgtgaagtaagcgtgacgggacgaagggcgggcgtggcgctcagctcttcggcagcccgggcggattcgtgcgcgactggtcgatcgcctcggacgcgaggttccagcggtcgagcacctgctggtagcggccgttcctgatcaacccgttcagcgcgacggtcagcggatcggcgagcccgctgccgcggcgcgtcgcgatcgcgatgtcggccgtgcgcggccagccgccgctgattgcgccgacgagccgcgtcttgccttgctgcgcgctctggtatgcgagcaccgagttcacgctgaacacggcatcggcacggcccgactgcacggcgacgatgcgcatcgcctggtcgtcgtagtactggatctgcacgggtttcagcccgtgcgcgacgttctcgcggtcccacgcgagcaggatctttcctggttggtgccggcgtcggtcacgatacgcagccccgcgacatccttcggctcgcggatcgcctggatcttgctgtcgttgcgcacgtagaagccgacctggtccttgcggtaggtcgagaaatcgaacttctgcttgcgctcctcggtgacggtgacgttcgagatcaccgcgtcgacttttccggattcgagcgcgagcggccagtcggcccacgcgagcgcgacgatcttcagcttgcggccgaggctgtcggacacgagctggccgacgtcggcgtcgaagccgatcaccgtgcgagcgtcggttgcatacgaactgatcggcggcaggctcggtgcgatgccgatcgtcagcgtgccgggttcggcgaacttgaacgacgcgggcaccgcgcgctcgactgccgcatcggccacgccgcgcgggcgcccgcgctgttcggggctcaagtcgaacgtggcggcggccgcgaccgcggccgcggcgaacgcggtcaggccaatcaacgcggtggccagcgtgcgcgcggcacgtgaagaaaacggtacggctcgttgcatgaaagcgtcctgtggtggcaagcggtaatcggaggaaggcgggggcgcggcggcggtcagcgcggcagcgccggttcgggcacgggcgcccacaggtcggccagcgtcgacgtgcgcgacggatcggcgagatccttgccgaaccgcaggtggtaatgcacctcgggggcgatcgacgaatcgaacagccgcgtatagccggtgcggtcgtacagcgcccatgcttcgggctggcgaaaaccggtagtcaggtagatgcggcgatagccctgctgcgcggcgcgcagttcgagtgcctccacgatgatgcgtgcgaggccctgacggcgcaggtccgcgcgggtccagatgcgtttgagctcggcggtctgcgcgtcgtagcgcttgaacgcgccgccgccgatcgtctcgccgtcgcgcagcagcagcacgaaagcgccttcgggcggcgcgaacagttcggccggataacgcgcgagttcctcgcgtgcggacgcgtggctgtcggggcgatacgcgttgtaacgggtcgaatactcgtcgatcagtgcgtcgatcagcggtcgcgcgcggacgtcgagcggcgtcgtgtcgatgatgcggtcggtcgtggccatgggcatcgcgaagggcgcgcgatgcggacgttcctggcggggtgcgggcacgcggcccgtccggtctgttccgttatcgcgacgcggttgtcgtgatggcggcggccggtgcgagtcctgctgggatgcagatggcgggccgccgccgttttgaacacgttagcggcgcggccggcaaaggcgaacgaagcaatttcgataaggatttcgcggcggacgtcagaaggctcgcagcgggagtggggtggcgatgacgcggtgcatgcgcatgcatcgaagccgatgtacgcgcctgcgcgatgccgacatgcgagcgcctatgcggcccggacttcggcgagcagatcggggtgacgatcgaggatcttcagcagtttcacgagggcaagcggcggattcgtcttgcctgtttcgtaacgggagaacgcgttgacgccgccgccgaaaagctcggccgcctcgcgctggtcgagcttcagcttcttgcgcaccttcgcgatgtaattcgggtcgacgatggtggcgttcacctgcttgttgaactcgccgatcgcttcgccgagacgggtcgcttcgtcgagatccagcaccgattccccgcaggccgggcagaactcgccggtgacagcgcggacgacagtcgaccggcccttgtaggtataagggatgtcgcgcgtgtcgcggacgagcttcgcggcaccgcatgcaggacacttcattttcatcgctccttgaaagacacgatcagcacatcgtcgatcaccgtcagtttcaggtacacgtcgccacgcaccgtcaacggccggtagacgtcctgccagatcgtgtggtcggcgtacgtcgtcatgctcttgtggaagtcgaggtcggtcagcgacatcacgacatcgagcgcctcccgttccgtgaaacccagctgccgcgcgccgagtaccgcgctcgcggtcaaccggacctggccggattcgaccagcgccttgacgagggcagcttgcaatgaggccttctcttttccattcgcgatattaaccaagtaagttaatttgtcaagttggttaatggcgagcgcatgccgtccgccatgactggcagaccgcatggaaaggagatggatccggttttaggccgtctggccgatgctcggcggggtcgacaactccgccagctggaacaggcaatcgccgcgctgcacctgcgcgggcacgcgcttgcacaccacttcgccgtcgcccttgaagcggtgcagcaccggctcgcgcagcggcgtatcgggaagtgcacccacgcggccggctgcccggccttcacctggtcgccgagttcgacgagcggctcgtacagcccgcgctcgtacgcatagacgaagtggcgatcgccgtcgacacgcatgaagcgcgtgacggtgggcggcgcgtcgggcacgagcgcgccgcgcagcaggccgatgtaaccgaggtagtgcagcagcccgtggcgaccgagccggatcagcgacgggtcggccatgccggcaccgccgagttcggtcacgatcgagatcgcgccctggcggcgcgcggccgaggccgagtgcacgggattcggcgcgtgcagcagcgcgttctgcaacccgaacgcgaccagcagcccgttgagcttcgcggcttcgtcggcgtcgagcgggtcgatcgcgagcatgttgccgccctggtacagcagcgagctgccgcccgagtgcaggtcgaccagatactgcgagcgcgccagcaggacatgctcgatgtagtgggcgatcatctgcgtcggcgtgccggccgggtcgccgggaagctgcggttcaggttgccctggtcgagcggcgacacgcgcaggcccgcgtccgccgccgggaaattcgccatcggcagcaggatcagctgcccgctgaccatcccgggctcgatctcgcgcatcagttgcgacacgatgatctggccttcgtactcgtcgccgtggttgccggccatcacgagcgcgaccgggccgtcgccgttgcgaatcgacgcgatcgggatcggcagccagccgtacgccgagcggtgtacggaatgcggcagccgcaggtagcccgcgtgcttgccttgtgcgtcgagatcgatttcgcagtggatgggattgcggtgtgaggaggaggcggtcatggcggcatcgttcgatgaacggaatctgccatcttatcgggaaacgaccgctgcgcgccgcgcccgcgcgagcagcgccgaacgccatcagccggcaagcgcatggaggcatgcgggtgagttgcaaagccgatacgcggaacccggtgcgatgttgcggcggtgaacgcatgccggcatgccggccggccgcattctggcctggcgtttcgcgccggcccttgccgcgacggggccggcgtgcaagggcggcttaccggcccgatgtttcagcttcgagacgtccttcttcccacagtgcccagaaacggctgccggcgcgatacggattcgcgcggcgcgcggcgtgatcggcgatgccctggcgaaacgcgccgtacagcgtcagcggcggattgtcgacgcatcgggcttcgcgtgcggccggcatgcggcgttcggaaacgagccggcggatcagcgatgcgccgtcgatcacatccagttcgtcgatggtttcgctgcggctgaggacttcgacggtattcatgttgggtctccctgaccacctgtttccctgacagggagcaataagagtgccaggttcgaaaagccctgcgctgcctcgatcgtgcaggcttctgcagccaacgtgacgggtggcgggcgccgatgttacggaacacgtcacgtgacacgcgagcgcgcgacgccacgtgcggtcacgtaaagcgtttcggaattgaatcgccgggaggcgtcgacgcgggagaaagagggctgcgcggccgggtcagctcgcggtggccggcgtgacccggctgctgccgctcgaatagaagcggtagatgcccttgccggccgatttcgcgtcgtacagcgcgctgtcggcctgccggatcagttcgtcggggagccgtgcccgtcgtcgagtgcgatgccgatgctgatccccaggatcacggtctcgccgatcgacagcgtgtacggcgccgagatctgccggatgatgcgcgccgcgaggagcgagcacgcgtgcatcgtcacgtcgtcgatcgcgacgacgaattcgtcgccgccgatgcgcgcggccagctcgccgggcggcagcgtcttgccgagccgctcggcgacctgcgtcagcacgtcgtcgccggcctggtggccgaaccggtcgttgatcgccttgaagccgtcgaggtcgagatacatgacggcgagcccggactccggcgtgtgtggccggctcgcgagcatccgcttgagttccgcatgcagctcgtggcggttcggcagacccgtcagcgcatcgtgccgcgcgagatgccggatgtgctgttcggtctggcggcgcgcggtgacgtcctcgacgatgatcaccgcgttgccgtccggcacgagatggcgcgtcaattcgagctggcggccatcggcgagcaccaggtcgagcggcgcgggttcgtcgcaggccagccagatctcgcactgcgcggcgagacgggcgccgccgggatcgatcgcgtcgttcgcgccgagcgccgcgacgacggcgggcagcggcgtttcgagcatgatctggcgcggcgagccgaacagttgcgcggtgcgccggttcgcgacgatcacgcggcgctcgccgtcgatcatgcacaggccgtgcggcatgtaggtgagcgcggcgtcgaagcgcgcgacgagttcggcgttgcgctggcgcgcggcaatcagcgcgacgagcacgcgatagtgacgctggacgaccgtgcgcatcgcggcgaggtagatcacgagcggcggcagcagcagccacgcccccggccggtgggccagcaacgcgccgatgccgatcggcagcacgccgaccgtgacctgcgacatcgcgagccggggcagcgccgaattgcgcgacgcgatcccgccgaacacgccgcccgcgaccatcaccgacagcgtgccgagctcgacgtcgacggcctgcacgcagcccatcacgccgagaccgagcacgaagcacgcgacgagcgacacgggcgcatagcgcattgcccagtattcggcgcggtcgtcgccgccgtcgcgttgaaccgtgtacgcacgcgcgatcgagagccgcgcgatgagcaggccgacgtcgacgatcagccacgcgaggcaccagagctgctgcagccggatcagcgcgacggccgcgacgaagccgctcgcgagcccggagagcgccatcggtcggacgtcctcgaacagggtaacgagcatcgacgggcgcagcgcggccgtcacacggtggttgccggagggggagtggcgagaacggagtgcaggagagatgccctgactgccatggtttttgacctcgacacgatgtcgcttgatatcgcgatggctggcggcatccgcacggcacgtggcggatgcccggccaggccggatgcgcacgacattaccatgaaatacgggcggcgcgggtcacccggatcgcccggcggacccgcgtgccgcgtcggccacgagtcgtcaaccgcgcccacgaaagtcttgcgcattcgccggcgccggggcagcatcgtcgcgaaccgaacgaggctcggcgatcgacaggagacaggcgcgtatccgccgtgcgcggtcgacacgaacgaaagcgccgcaagcgggcagtcgatgcgaccggatcgccacccgcgaccggctgtcgcagcccggctgaacaccgttataagaaattcaataagtatttcatgcgggaaatactataggcgatatatcaaaaacaatgccagaatgcgcgccgctccgaacgtcgcgacatccgatcgccgtccgagccgcatcaggaggttcccccaatgaaaaaccacggcctgtcacggcggggttttctgaaagccagcgtgctggcgggcgtcgcagtgtatgtcgcgccctgggcagccgcgcgttcgcggcgctcttcgaagaaaaactcctcaccccgtcaaatgggatagcgtcaccggcatcccccaattccgcatcgacggcatcgcgaaggtcacgggctcgaaagtgttcgcccgtgacgtgcgcgcagccgacatgccgcactggccgcagcagcagtctcatgcgctgatcctgcgcgtcacgcaggccgaccgcacgtacgaaggcttcgacctttcgctgctgggcgacgaactgaaaccggaccgcgtggtcacggccgacgatctcgtgcgcgacggcgtcgcgtttccggcgttctacggcgacgacatgctgctgcccgccggcaagacgcccgcgtatctcggccatgcggtcgcgatcctcatctaccacgacttcgcgcgcttccgcttcgcgaagaacgcgctcaagttccgcgacgacgtgatccgctacggcgcggtcacgggcccgctcgagcgcgatccgtggggcaccttccgctacgtgcgcgtgggcggcaagacggcctacgacgatgatgtctattcgagcctgaaggacgcgccgatctttccgagcatgatgcgcaagcacctgccggtgtggccggacggcaaggagcacggcaagctcgacgagcagggcatgttcctggctgggcagatcgcgagcgagctcgaccatccgtcggccgactggctcgtgttcgaccgcgagtacaacacgcagtcggtcgacaccgccgcgctcgaaccggacaacgcgaactgctggtacgacgccgcgacgcagtcgctgcacctggtcgtgccgacccagtcgccgctcgaagtggcggagaacgcggccgcgatggtcgcgaagtgccgcttcccggtgaagaagctgttcgtgcatccgtgctacacggtcggctacggctcgaaggatcacttcaacgtgccgttctacggcctcgtctgcgcgctgtacgcggacggccgcccggtgcgtttcgcgaacgaccgctacgaacagttccagacgtcgctgaagcgtcacgcgttcaagatgcattaccggatcgcggtggaccgcaacaccggcctgctgcagtcgttcaagggcgacttcgaggcgaacggcggcgggcgctcgaacttctcgccgtcggtcgcgatggtcggcgcgacggccgcgcaatcgatctactacttcccgaagagcgacctggccgcggtcgcgatcgcgtcgcgcgcgatcgacgcgggttccgcgcgcggctacggcacgctgcagagcatggcggcgaccgagatggcggtcgacgagatcgccgcgcagctgaacatcgacccgatcgatttccgcctgcgcaacgcgctgcgttcggggatgaagaacacgcaaggggcgattcccgccggcgcgctgcgcgtcgacgaggtgctcgaacgctcgaagcagcatccgctgtggacgcgccgcgccgcgcgcaaggccgaatacgaggcggcgaacccgggcaagcgctacggcgtcggcttcgcgtgcgtgcagaaggacttcggcacgggcgcggaagcgtcgttcgcgaaggtcgaattcgacgagaacggcaaggtgtcgctgcgccacacggctgccgagattggcaccgggatgtcgacgtcgcaggctgtggccgtcgtgaagtggctcggccgtccggcgacggacgtgcaggtcgccgtgaccgaatggccggacctgccggtcgagaccagcggcgatccgtacatcatgtcgcaggccgaccaggatcgcctgagcgcgaatccgcgctggtcgccgagctatgcgtcgccgtcgagcgcgacgaactccgcgtactacttcacgcacagcacgcgcgaagccgcgcgcgcggtgttccgctacggcctgtggccggcggcgatgtcgatctggacgcgcggcctcggcggcggccaggccgcgccgtacacgatccgcatcgaggacgcgcgctgggtcgacggcaagctgaccgccgacggcctcgagccgctgtcgttcgaacagctcgcgaagcaggcgcatgcgctcggcctgccgaccggcgccgtcgtgcacgtgttcaaccgctggcagtggaccgacgccgagttcgaagtgggcggcgtggtcgatcgtttgccgatcgacgggctgtcgctgcgcgtcggcgcaccgaagacgggcgacaacggcccggtgcccggcaccgccgcgcctgccggcgcgaccgcgatgcgcggcacgctggcgccgaccgcgaacggctaccgcgtgctggaccgcaagcgcgtgttcatcccgccgacgagccgcaacaacgcggccgtcacgtactacggcggtcggcacgctggtcgagctggccgtgcatgaagcgaccggcaaggtcgagctgctcacgcatcactcgatcatggaatgcggcaaccagatttcgccgcagctcgtgtcgggccagttgcagggcggtctcgcgatgggtatcggccacgcgttgcacgaatacctgccgctgtatgaagacggccccggcaacggcacgtggaacttcaaccgctaccagctgccgcgcgcgtccgacgtcgccgtctggacgcagacgggcgacgtgctgccgccgctgtccgagaccgatccgccgaagggtgtcgccgaagtggtgatgatccccgtcgtcggcgcgatcgtgaacggcatcgcgcacgcgatcggccatcgtttcaccgacctgccggtgaccccgcaaaagattcaggaggtgctcgcatgacgaccgcccaaaccgcggcttcggccgcgagcgccagcgccgctgcgaccggcgcttccgcaccggcccaggcttcggctgtaccggcttcggcaccggcctcggccccggctgtgccggcaccggcatcggccgccgtcgagcgtccgctcgtccggttccagtcgaaaccgctgtcgatcaacatcaacggcaagtccgtcggcccgatgcaggtgccggaagggctgatgatgatcgagttcctgcacgaatacgcgggcctcaccgggtcgcggctcggttgcgggcagggcatctgccacgcatgcgtcgtgatcgtcgacaagccggacggcacgagcgaggaaatgcgcacctgcatcaccggcgcgcatttcttccacggccgcacgatccgcacgatcgaaggccacgcgaagcgcaacgaagcgggcgaagtggtcgagctgtcgccgatccagcagaagttcctcgagcacttcagcttccagtgcggctattgcacgccgggtttcgtcaacgcggcgacggtgctgatcgaacgcctgaagcgcgagccggttgcgaaggccgacgtcgagcgcacgatcaccgaggcgctcgatgcgcacctctgccgctgcacgggctatgtccgctactacgaagccgtcaaggacgtggtgctgacgacgccgggactcgtgaaggacgccgcatgaaacgcacattcgctcatcgtgtcgcgcgggctgcgggccttcccgtgctcgcggcggcttgcgcgctgctgctcgccgcatgcggcggccacgacgcaccggcctcgaacgccgcttccggcgcgcccggtgccgacccggtcgcgcgcggccgctatctcgtcaaggccgccgactgcgcggcctgccacaccgcgaaggacggcgcgccgttcgccggcggcgcgccctcgaatcgccgttcggcacgttctacggctcgaacatcacgccggacaaggatcacgggatcggcaactggagcgccgacgatttctacgccgcgctgcatgacggcaaggcgccgggcaagcgcctgtatccgtcgatgccgtacacgtcgtaccggcagctcacgcgtgccgattccgacgcgatgtacgcgtacctgaagaccgtcaggccggtcgcgcaggaaaaccgcgagcacgagctgaagttcccgtacaacctgcgtttcgggatggtcttctgggacatggtgttcctgaaggacagcctgcccgatgcatcgaccggccagtctgccgactggcagcgcggccgctatctggcgggtgcgctcggccactgcgcggaatgccacacgccgcgcgcgttcacgggccagctcgacagcgcgaagccgttcgcgggcgcggcgctcggccgcgtggccgcgcccgacatcacgccggccggccttgccgcgcgcggctggacgggcgccgacctgcagacgttcttcggcgtcggcatcgcgccgcaaggctcggcattcggcgagatgtacccggtcgtgcacctgagcacgcagtacatgacgaaggacgacctgcgtgcgctgtccgtgtacctgctgggcgacacgccgcccgcgccgcaaccggtgaagccggtgtcggccgacgccgcgcagctcgcggccggccgctcggtgtatctcgcggtctgcgcggggtgtcacggcttcaacggcgaaggcaagccgcacgtggcggtgccgatgaacggcaattcgacggtgcgccagggcgacccgcgcaacctgctggtcgcgatgctcgacggcatcggcgagcagaagttcgccgggttcgagaacctgcagccgatgcccggtttcgcgcacacgctgagcgacgacgaactcgcgcagctcgcgaactacctgcgtgcgacgtggggcggccagccggcgagcgtcacgccggccgacgtgaaggccatgcgttaagtcgtgtcgccgggcggggcgtcgcgcgcgattcagccggtttccggtgctcgtgcgcgacgcgtcgcccgactgctcgcagcggttcttcagtagccgctgcctcctccgccaccgcccgtacctcccgcgccactgccgccgtaccggctcatgcccggcccttgcggcgcgccgccacccgacgtacagcctgccgacagcacgagcaccagcgccgcgaccagcgccgcggccaacgttgcggatctcatttccacctccttgcaacgcgcaggccgcgggaaaggccggttcgcatgaaccgtgcgtctgcgcgctgaagaaacgtttcgggcgggccgtttattccatgccttttgcggatcgtcgaatgcgagggggcggatcggtgtcatcgcacggcgtgttgatacactgcggcacgccgccattccggttccgaccacgaaaaacatgagtgccgccgctgaacgtccgtcgtcgcgtccgtttcgtcccgccgtgctcggttgcgtgtcgtttgccgtcggcggcccgctggtcgcatcgctcgtctggccggccgtgatgctggtcgggtggtcgttgatcgacggcccgtcgtgggaggaactgaaagtcagcgccggcatggttccgctgatcttcttcgcgtcgttcctgttcggctatttcctgccggcagccgtgaccggcggcatcatgggcgcaatcggcacgcggctccggcggcgctggttcgtgctgctggggatggtcgtcggcgccggcgcgatgatcggtttcgtcgaactcgaggattacctgatgaaaatcgaccagttcagcgacatcgacgcgattgccacgctcgatgcgatcgtgacgtcggccgcgatgtcgcactggctgcatcgccggctcgatcgccggcgttgagcacgcagcgttgcgcgatcggtcgccttcgcgtcgatcgcgtgcatacggcgggcaggggcggcaccgcgcggccgcttgcgcgaccagcgggctgccatgccgttcctgaagcgaatgccgccgtcacggcggcccgggatcaacgatagacgagatccgcgcggcggttctgtgcccacgaatcctcgtcgtggccgagcgcgaccggcttttccttgccgaggctgaccgcctcgagttgcgtggcttgcacaccgagcgtttcgagcgcgctcagcacggcctgcgaacggcgttggccgagtgcgaggttgtattcggacgtgccgcgttcgtcggtgttgccctggatcagcacgtgccgcgccggatggctgcgcaggtagtcggcgtgtgcctgcagcagcgactggtattcgggcttgacggagtactggtcgaaatcgaagtagatgctgcgcttcgcgagcgggctgttcggattgttgagctcgtcggccgtcaccgttgcgacggcttcgctcgagggcgcgggctccatgccggcattctcgggtgtcttggccgcatggtggcaaccggccagcagtacgacggttgtcaggaccgcaaatcggttcgttttgctcatcgttcgtctccagcggttgactgcattgaacgcgtggggcgtgcgatcggcacgcccgtatccggccgaacggcgcgaaagatccggcatctacgacgtgaatcgtgttcgtaagccggtggtgcgccatatgaaagagtgttgcggccggaacgccaaatttcggcgtcgctgcaaacagattaggaaaaatgtcacagcgtgaccagtttctccgcattttttgcgtcgacgcgacagaccgggcggcattcgtgccgtcacgcggcgcgatgccgttgcgcacaggccgcgcacgggcacggcctttgcggctcggagcatgacgctcgagcggtgccgaaacgcatgccttgcgcggatggcgtagcgacgccgtgcttcgtcttcagaacttgtgccgcagccccagtgcgacgacgacctggttgctgttcgccgacggcgtcagcgtccagacggtcgcgttgaacgcgggttgccgttgccgccgctcacgctctggtagaccccctcgagatacgcatccgtgcgcttcgacagcgcatagtcggcttgcgcgacgacctggttccatttcggccgcgtctggccggtgcgcgtgtcgaagcggcccatcgtgtacgtgtacgcggccgagaggctcaacgcacgcgtgacggcgaagcgcccgtcgaccgagaagttgtcgaacaccagcgattccccttcaacggcgtgatgccgctgccctggagcacgcccgccacgccgtcggtggtcgagtgcgaccacgcggcgccgaccgaatgcggcccgaacgcataacggccggccgcggcccagatctgctggttgccgcccgtgatcgtcgccgagccgtcgaccgtgctgagcgcaccgttcgggttcggcgcattgcggtcgcggctgatcttcaggtagccggcgccgagcttcagcggcccgttcgcgtacgacacgcccgcgctccatgccgcgttgttggcgaactggccggccgtgttcgagaagccgtacatcgcgccgaacctcagcccgcgatacgtcgggctcgtgtatttcaccgcctggttgatgcggaggttgcggttcgaatcgtcgttgtcgtacggatgaaccgcgaggttgccgccccagccggggccggacgcgccgagcggcgtcacgaaatcgaggatcaggtcgtactggcggccgaacgtgagctcgccggccgtcttcgagctcacgccgacccacgcctggcggccgaacatgtcgacgcctttctgcgacagcgcgccggtggtgcccgagaaaccgttctcgagcccgaagatcgcggccatcccgccgccgagatcctcgcggccgcgcaaaccccagcgcgatgcgttcagggcgccgctcgtcatcgcgacggtgccgctgcccggcgagccggcgccgtgcgtgcgctggttggtcgcgtaggtgatcgacgtgtcgatcaggccgtacagcgtcacgctgctctgcgcgtgtgcgccgtccgacgcgaaggcggtcaggcaagtggcaatggcggtccccgcgagtcgcgtgctggcgtgtttattcatcttgtaggaatgcaaaggagtttttatcactttaccggcgcggtggccggcggatcgagcggccattattggagatcgcgcggcggtcgattaaggcgttgcacaggaaaggtcctctgcgaaatcgcgtggaatcgcggcgggacgaaggcggggagggcggttcggcaggaaacccgtcgccgggtttgcgatgcgctcgacggttcgacggttcggcgggaagtcgggtgattcagttgaccatcgcgtgatcgtccgtcgggcgatggccgacgggagcctagcggcggccaaccggtagcgcggcttcgatgccaccgctgcgatacgcggcacgaacggcgaccgccctggcttcgagtgcttccggtgagagccagggccgcaagcggaccgcgacgcgcggcaatccggcaagctgatcgcgcaggcgcacgatcgaccggcagccacggaatgccgacgacccggcgtcggggccgcacgcggcttccgcaagctcggccgcccactcgacgcctcggtggcgcctgacttcgtcgaggtgcggcagatggcgcgcatcgcccgataacgcgatcaacagcgcggcccagtgcgcgccacgccatccagcgttcatgtcggccgtgaggtcggccagcagcgtgtcgtccagcacggtcaggctttgctggcacaggtagtggaagtcgagcggctggtagcggacctgcgggtagtcgcgcagcacatggccgagttcggcgccggtctcgacagcagcggccaggaaccgttcggccggcgccgggcggttcagctgcagcgtcggcacgctccggtagagccggtagatgtcgtcggggtgatagtgcatcgcgaatgtcggggtgatcgaccggcgcgcgcggcgcggttcaggttttctgctggtcgccgggcagcagcgccgcatgacgccgctgcatttcatcgggctcgaccgcttcgatcgtgggcccgatcggccaatcgtaaccgaacgggtcgcgaatcttgccggggcgctcacgtcgggttgtctacgattccccgaggggcgaaagcgatcgcggtatgcgccggggctgaggccgaccttgtccttgaacagtcggcagaacgagctggtatcgctgtatcccacctgggccgtaatccgctcgaggctgagatcgccggcctccagcaggccgcgtgcggcttcgatgcgcaggttctgcaaataccgcaatggcggctgattcagcgccgcgcggaatcggcggatgatcgtgcgctcgctcacgccgagctcatgcgccatctccgacatcttcacgtccttcgtcatgtgcttctgcagccaatactgcgcgcggtgaaccagcgagtcggcgtgttccttgtccgccagcaacgggagatacggcaactgcttcgtctggctgacgtcgatcagcatcgtcttcgcgcactgcgcggcgatggccgcgccgcagaagcgctcgatgacatggatggtctgcagcaggtaggacgccgatgccccggcacagatcaggcggtcggcttcggtgacgacgggttccagctgaaggtcgacgcgggaaaccggctgcggaactgatcggccagccaccaagtggtcgtcgcgggccgttcgtccaggaggccggttctggccaggacgaacgtgccggtgcagttcgccgcaaggtatgcccccgcgttccattgcgaaaccagccagtcgcatgcggccgactgtcgtgccagcaaccggtcgaaggccttgccgcttgcgtaatgcgcactgggaatgaaaaccaggtcgaacttctcgcgcggccggatcggctccgtgttcagttgcaagccgttgctcgccatgaccggcttccccgtcggagaaacgaaccgccattcgaactgcgcattgccatcgccctttgccgccgccagtgcgcgttcgcgatctgcaggatgtcggcgaacccgcccaggctggaagcgtagcaatcgtcatacgcaagaatggcggcgcggggcatgatgtgtcgtatatcgcattcaatgtgtcagtttcgccaatgtacggcagttcggcccgcgaggaaactggtcgtgtcaacctggcgccggttggcgggcagcgacagaatcgccatgcggccggcagcgaggggaggcggcatcgtgtgccgtccgggtcgcgagaaggccaatgtggccgccccgggtaccgccaggcgcattcgttgcccggcagcgtggatttccgtcggcgttgcaccgtcgattcagccgcgcagtgacgcgcgtcggggccgcaacgcgtgccctgcatgcgaaggcgctttcgtctcaacctgaaccgcaaacatcatgaaaaccaggatcaccgaactcttcggcatcgactatccgatcatccagggcggcatgcaccatgtcgggtacgcggagctggccgcagcagtctccaacgccggcggactcggcatcatcaccggcctgacccagcgatcgccggccgatctggccgctgaaatccggcgttgccgcgaaatgaccgacaagccgttcggcgtgaacctcacgttcctgccgaccgtcacgtccccgactatcccggctatatccgggccatcgtcgaaggcggggtcaaggtggtcgaaacggccggcaacaacccgcagccctacctggccgcgctcaaggaagcggatatcaaggtgatccacaagtgcacgtcgattcgccacgcgctgaaggccgagtccatcggctgcgatgcggtcagcgtcgacggattcgagtgcggcggccatccgggcgaggacgacattccgaacttcattctgctgccacgcgccgccgaggaactcaggattccgttcgtggcctccggcggcatggcggacggccggtcgctggttgcggcactttcgctcggcgcggacggcgtcaacatgggaacgcgcttcgtcgccacccgcgaggcgccggtgcacgagaacgtgaagcaggcgctggtcgcggcctccgaactggatacacgcctggtcatgcgcccgttgcgcaataccgagcgcgtgctgcgcaatgccgcggtcgatcgcattctcgaaaaggaaagcaggctcggcgccggcatccggttcgacgatatcgccgaagaggtcgccggcgtgtatccgcgcatcatgaaggagggcgcgctcgatgcgggcgcgtggtcgtgcgggctggtcgtcggcctgatccgcgatatcccgaccgtgaaggaactcgtcgagcgcatcgtgagcgaggcgacggagatcatccgcagccgcctggcacgtatcgcggtttgatccggatcggcgacacgggatgccgccggcgcgatgccggcgaggattcgtgcgggatgtggttggcgagggccaaccgggcgaccgcggcgatgaccgaaagcgtgcggttggtggccgctgtgtcgatgtagagtccgtcgcgtcgtcggttccggtcgcctcgcggcgcgaccggactcgagcaccctgtccgtcatgacctgaatcacttcacgacggccgggtgctcgtgtgttcaatgacttcccgttgtcgaatcggctaacccgggttggctgattccgctttctcctcgggcagcgccccagacatcatccggattccaacctggccgacgcaaccgcatcgcgtcacgtgagcccgatgcggtttctcccgggctcggcgcatcgcaagccggcgcccgcttcggcgatcggcccatgagatgacaaataccgtcatcgacggatcgcgatcttgcgtgcggcgatataattcgcgctccgagggccttcgagcccgaccgcgaatacaagacaagaagaagcagacatggctccgtctcaaccgcatgcattgcagcgtccgcccgctgaagtcctgtatgccgatcagctcgcgcagctgaaggcgcaggatggcgcccaaccacgcccgccgggctggcaactgagtctgacggccgcccgcgcattcattgccggcgatcgctcgctcggcatcgcgccgaaggtggtcgcgccgatcgcgagcatcgagcgcatgctcgtcacgctcgccaccgggcgcgggctgatgctggtcggcgagccgggcaccgcgaaatcgatgctgtccgagctgctggcggccgcgatcagcggcacgtcgactttgacgatccagggcggcgcatcgatcaccgaagaccagatcaagtacggctggaactacgcgttgctgatcaacgaagggccgagcccgcgcgcgctcgtgcccgcgccgctgtaccagggcatgcacgacggccggatcgtgcgcttcgaggaaatcacgcgcgcgccgctggaagtgcaggactgcctgctcggcatgctgtcggatcgcgtgatggccgtgcccgaactgcacggcgaacacgggatgctgtacgcgcgcgagggcttcaacatcatcgcgaccgcgaatacgcgcgaccgtggcgtgaacgagatgagcgcggcgctcaagcggcgcttcgatttcgaaaccgtgtttccgattctcgacttcgacagcgaactcgcgctcgtgcgcgaagccagcgcgcgcctgctggccggcagcggcattccggcggccgtgccgcagccggtgctggaactgctggtcaccacgtttcgcgatttgcgcggcggggccggcgatgcggcgggcagcgacggcgcgatggaccggctgacggcggtgatgtcgacggccgaagcggtgaacgtcgcgcatgcggtcggcgtgcgcgcatggtttctcgagcagcgcgaagggtcgccgcaggatctcgtcgactgcatcgccggcaccgtggtcaaggacaacgccgacgaccgcgcgaagctgcgccgctatttcgaacagaaggccgcccggcgcgaaggggcgcactggcgcgcgtactacgcggcacgccaccgtctgccgtgacgcgcgacatgagtacgaccgatcgcggcggcatgcacgggccgggacgtcgtgcgcccgatgcgcatcgcgtgcacggcgacaagggcgtaaagagcgtaaagggcaggtcgggcgccatcgcgtccgacgcccccgcacgcatcgtcttcgactgacaggcgccgcatgcagaccgtgacgcccggccagccgcacatcgtcggcatccgccatcacagccccgcgtgcgcgcggctggtggccgagcgcatccgcgcccggcggccgcgctacgtgctgatcgaagggccggccgacttcaacggccggctcgacgaactgtatcgtccgcaccgcctgccgatcgcgatctacagctatctgtccggcgataccgcgcattacggctcgtggaccccgttcgccgagcattcgccggaatggcaggcattgcaggcggggcgcgaagtcggcgcgacggttcggttcatcgacctgcccgcgtggcacgcggcgttctcgcggctcgagaaccgctatgccgatgtcgcggacgccgaacacgaggcccgcgccgacgcatacgagcgcgcgctggcggacacgctcgcggtgcaaggccgcgatgcgctgtgggatcacctgttcgaggacgtcggcgatacgccggacgcgctggacgaactcgcggcgcgcctgtcgacctacttctcgcatctgcgcgccgacgatccgggctcgctcggcaaccaggcacgcgaacggacgatggcacgctggatcgcgtgggccgtcgccgaagccgacgggcaggcggacgacgtgctggtcgtctgcggcggctatcacgcgccggcgctggcgacactctggcgcacgcagccggacgcgttgcccgatacgcccgaacgcggcgcgatcgacgtcgatgccggtgccgtgcccgacgaacgggacgctgacgccggcgcgtgcgagacggattcgacgaccgccgacgcggccgcgcgcagcatccgctacggttcctatctcgtgccttacacgttcaagcgtctcgacgcgttcgcgggctacgcatcggggatgccttcgccggcctattaccagtgggtctgggctgacggcgcggaagcggcggcgcggcgcgtgctcgagaacgtgatgcagcggctgcgcgcacgcaagctgccggtatcgacggccgacctgattgccgtgcacgtgcgggccgaagggctggcacgcctgcgcggccacgcgcggccgttgcgttgcgactggctcgacgcgctggccggcgcgctggtgaaggaggcgctcgacgcgccgctgccgtggacctatcgcgggccgctgcgggccggcaccgatccggtgctggtcgaggcgatggatgcgctggcgggcgacgccgccggcgagctcgcgcccggcacgccgcaaccgccgctcgtcgccgcggtgcgcgacgagctggccgcgctcggcatcgtgctgcacggcacgctgacgctcgacctgctgaccgaccaggggcgcgcgcgcagccgcgtgctgcaccggctggcgctgctgcgcgtaccgggcatcgtgcgccgccagggcgcacggcttgcgatgtcgggcgaacgcgacgaagtctggcagctcggcgagccgcttgaacaacaggcggcgctgatcgaagccggcgcgtggggcgcgacgctgtccgacgcggcacgcgcgcggctcgaggatgaattgcgtgaggcgggcggccgcatcgcgccgctcgcggatggcctgaaccgcgccgcgtgggccgggctggcagcgctgagcaccgcgctgctggacacgctgcacgatgcggtcgcgcgcgagcagcgcttcgagtcgctcgccccggcgctcggcaacctgcatacgctgctgcgtcacggccatctgctcggcatgaacgatgcaccggtgctgcggatcgtcgtcgaggccgggttcgatcgcgcgctctggttgctggagccggccgccgcgctaccgccggccgatctcgacgcccacgtgcagggcacgtcgcgctgcgccggatcgtggccgacgtactggccggtgccgacggtgtcacccacacgccgctcgcgctcgagccgttgcgcgcgctggccgtctggcggcgcaaggcggccgatacggcggcggcgcccgcgagtcgcggcgcggcgctcggggcgctgctcggcctggcggggcaggccggcgtcgacgacgatcaacccgtcgccggcatcgacgacgcgatggcgctgctgcgggcgatgccggccgccgcgctcggcgatgcgctcggcggtttgcttgcgctggcgcgcgagacactggcgagcgcaccggctttcgtcgcgggcatggatgcgaccgtgcgcgcgctcgacgacgccgatttcgtgctcgcgttgccgggcttgcgcagcgcattcgcgtggttgccgccgcgggagcgcgggcagctcgcggaccaggtgctcgcgctgcacgacgcgacgcacctgtcacgccgcgtgctgacggagcggcacgcggacgatgcgtcgcccgaggaggccgcgcacgccgcgcgcatcgaagcgcaggtgctcggccgtctgcgccgctggggctcacgcccgatccggaggcgtcatgaagtgccgatcgacaggccgccgcgcgtccggcttctgcttccctcaccacgatgtcgcgccgtcacggcacggtgcggcgcgttttccgcgagtcctgccatgccgctgaacattcctggtccgctcgaacgctggcgcctgctgctcggcgaaccggccgaagccgcatgcggcacgccgggtgcggacgcgcgagccgccgatgcggcactcgactggctgtacggtcgcgacgacgaccgtgcgcagcgcggcgagcgcggggccggcctcgggccgtccgcgctgagcacgccggactggatcaacacgatccacacgctgtttccgaaggaggtgatcgaccggctcgagcgcgacgcggtcgagcgtttcggcatcgacgaagtcgtcacgaacctcgaggtgctggagcggatcgagccgtccgaatcgttgctgcgcgccgtgctgcacacgaagcacctgatgaatcccgaggtgctggcggccgcgcggcggctggttgccgaggtggtccggcgaatcatggagcggctggcgaccgacgtgcggcaggccttcagcggcacgcgcgaccggcgccggcgctcgcggatgaagatcgcccgcaatttcgactacacgcgcacgctggccgcgaacctgcgtcactggcatcccgagcggcgcaagctgtatctcgacacgccggtcttcaacagtcgcacgcgtcgccacgccgagccgtgggacatcgtgctgctcgtcgaccagagcgggtcgatggtcaactcggtgattcacagcgcggtgatggccgcgtgcctgtggcaattgcccggcatgcgcacgcggctcgtggccttcgacacgtcggtggtcgacctgaccgccgacgtgtccgacccggtcgagctgttgatgaaggtccagctcggcggcggcacggacatcgcgaaggccgtcgcgtatgcgcaatcgtgcgtcgcgaatcccgcccgcacgatcgtcgtgctggtcagcgatttctatgaaggcggcagcggctacgaactcgtgcgccgcgtgaaggcgctggccgagagcggcgcgcgtgctcgggctggccgcgctcgattcggctgccgagcccgcctacgaccgcgagatggccgcgcggctcgtgaacgccggcgcgcaaatcggcgcgatgacgcccggccaactggccgcgtggctcgctgaaaggtgcggggatgagcgcgccgatccgcgacgacctcctcgaactgacgcccgaagcgctgacggcgctcgccaacgccgggttcgtcaagcgcgcgcagaaggatgtcgccgccggtgcggtgccggcgctggccgtcgacggcgacggtacggtgcacgcgtcgttcgccgacggcgtgcgtaccagcctgccgccgggccggaccttgcgcgacgcggcgtgcaactgcaccgcgagcggcatgtgccggcatcgcgtgatgctggtgttcgcctatcaggcgagcatgcggggaacgaagcggctgccccgggcgaggtgcgagcaggcggagacgacaggacggggcaggccgatacgcgcgatgaatcgatccgcaatccggacgatgtcgcgcgcggcgcaacaggcaccggttcgggtgacgcgccgccgggcgacgacacgaacggcacgtcgtccgcggatcgcgcatggagccccgccgatttcgacgatgccgcgctggcggcgagttttgcgccgtcggtgctcgaacaggccacgcgcatggcggccgcgcggcctgccgtgaccgtgcagccgtggtccggcgcacagtcgtcgccggttgcacgcctgccgatgtgcaccgtgcggttcttctcgcgacgttcgctcgcgcatgcgcgttgcgactgccggcaaggcagcggctgcgcgcacgtcgtgctggccgtctgggcattccgacaggccggggcatcggccgatggtttatcggagacgatcgtcgaggtgcgcccgccggccggcgaagcagacgagtgtggcgacgaccggtcgccgttgcgcgacgacgcggcgcacgcgctgatcgccgacctcgacaggctggtacacgcgctgtggctggacggttcgagccagccgccgatcgcgctggccgcgcgcgtggagtcgctgcgcggccgcctgcgcgagcgcggctggcagtgggtcgacgacgcgctcgacgaagcctggcagctcgtgcacgcgcagcatgcgcgcagcagccgcttcgagccgctgcggctcgtacgcgtgctggccgaactgtgggcgcgcctgcgcgcggcgctgtccgccgcgacgcagcgcgagggggccgccgtgccggcccgccagatgctcggcatcggcgtgaagggcgaggtggaactcgatcatctgcggctggtgtcgctcggcgtcgagctgtgggccgacgacgcggaagagggggcgagcgtgctgttcgccgatcccgatacgcagaccgtgatggtgctgacgcgcaactggccgcgtgccgccgacgtcgcggccggcggccgtgcgccggatctggccggccgccgcgtcgcgggttttccgttgcggcagatcgccgccgggcaggtcgtcacgaagaccgcgaagcggcgcgcgaacggtgcggtcgacatcgcggccggcatacggcagacaggcgtgctgccgctgtcgccgacatcctgggacgatctcgtcgcgccgatccgccagccgggcatcgcggcgctcgtcgcgcacctgcgtgacgcgctgcccgacttcgtgcggccgagacaggcggcgaacggtgcggcggccggcgcggccgggtcgctgcacgtggtcgcgttcgagccgatggtcgtgcggtcgatccattgggatgcggccgcccaggtgctgcacgtgcggctcgcgcaaggcgaaggcgggacggccgatgtggaaggcgacgatgtgctgcacctcgcgctgccgcatcgcgccgtggcacccggcgcggtcgatgcgctggcgcgcgcgttgtccggcgaatggggcgcgttgcgcgcgctggcgggcaccgtccggctgcatgcgggtacggccgtgatgcggccgctggccgtgttgaccgcgcagcgcgccgtcgtgctgcagaccgaggcgacggcgccgcaaccgctgccgctggccggcgggcgcgagtcgttgcccgcgctggtcgcgctcgcggaggacacgctggcgctgctggccgagtggctgcgccagggcatgcgccatcagggcggcggcgcgatcgagcgtgcgctggcgcaggccacgcgactggagcgggccggcctcgcgcacgcggggcggcggctgcgtgcgctggccgacggcctgcgcggtgcgcaatcggcgtcgatcctggcgcaactgggttcgctgacgttgctgctgctgggcatcgtcgagcaatgacggcatgaccgtcgaacgggcgagcaggcggcgcccgacaccgcgagccgtcgggcaggctgcacggctcgcgggatgaatgaacgagagggcgtcatggctgcgttgcggccatggcatgcgggcgcggcatcgtgccgcgtcgtcgatccgagtgagagggaacggatgcgtcgttttgaactgatcgaaggcaactccagcaagttctgggaagtggagcaggaaggctccgggctcaatatccgctggggccgcatcggcaccgcgggccagagccagacgaagtcgttcgcggacgacgcgaaggcgcgcgccgcgctcgacaagctcgtcaaggagaagaccggcaagggctatgccgaagtcgcggtagcggccggcgccggcatcggcgcgactgccgccaagccgccggccgccgcgtcgtcggcaaccccgaccgcggtgccgcaggcgtcggcagacgcggaaccggccgcgaacgcgcaacccgcagcggcaaaggccgcgaagggtgtgccgcccacgccgtcggtccagccggcggcatcgacgccgccttcaacggtttccggtgccaccgccgccgcgcccttgccgcccgtcgccgccgaaggattcgatgcgcagtgcgagcgtgtcttcgagaccgtgcgcgcgcagatcgcgaacggtgacctgaagcccggcgagacgttgacggttgccgtgatcaagcgccgctacgacgtcggcgaccagggcgccgcgatggcgctcgacctgctcaagtcgcgccgcctgctgcatggctggggagcgtcggccagcgtgcacgagcacgggcaggcgaccgccgtggcgctcggcgagtggttgacgtcccaggcggccgccgtgccggcgcctgccgcacccgccgtcgccgacgccggcgcaccgccgtggctgatgcacggcgatcccgtgcggctgtcgccgcagatcctgcgcgaagcctatgcgtcccgccgttttcccgtcgaggtgaccgtgctcgacgcgcgctgcgtggctgaagatcgaaggcaaggacgggtactcgatcgacatcggcgcgaccgacgcggcgctgcgcccggccgtccagcggatgctcgaccggctggccgcgcgtacgccgatcgccgggccggtggcggacgcgcaagccgacgccgcgctgttcgcgctggcgatgaccgtgggcgactatcacggcgaaaccgcgatcggccgcccggtcgccgactacctggttgcgcaatacggattgacgggcgcgatcgacgtgctgctcgacgcgttgaaaatccacgtgcacgccgattacgaccgtcaggcgcagcgccgcctccatcgtttctcgacgaatgtcgaaggcccggtgcgcgagagctggcgcgggccgatcgtcggcggcgaggcggctgcgcgagcatcttgccgcggcgagcgaggcggaatggcaggcctgcgtcgacaggatcgaggccgcgttgccggcgctgcacccgacccgccagccgatacccgcgctgttgttgcccgatgcgccggagctgtcgaatgcgctggtgcgcaggctgagcgccgaacgcgacgtgcccgagacgctgcactggatgctgctgaccgcgaccgatcccgatgtgatcgcggtggtcgggagaatccggccgaacagctatggccgcgagttctgggaatgtcgcggatggtcgcgaccgtgctgcgcgagcgcggcacggccgcgttcgacgtgctcgaacgcggcgccgccgccgacgaggcgggcgacgcgctcgccgcgatcggcacgcccgacgcggtggctgcgctggcgagggtcgccagcggttcgaagggcgcgctcgcgcgcctgtcgctgtcgctcgatcgctggccgctcgcgggcatggtcgcgctgtcgcggcttgtggccgccggcggcaaggatgccgggctgctgacgccgagcctcacgcgcctgttgcgcgcgcatacggcgcacgtcgacgggctgcggccgtggctcgacgcaccggcccaggccgtgatcgacaaacttctcgcgctgctggccggcccggccgaggtcgcctcggccgaggaattgccgggtgtgctggccgcgccgccctggcttgccgcgcggcagaagcgggcggcggcgctgacgctggagccgctcgaactggcggcggtcgaatgctgggacgaagcgaagcgcaaccaggcgaaaacgcccgaccagtgggaagcgaagcggctcgccgcggcgtcgaaggacacgatgatgctgatcgacggcctcggtttcgacgcgagcaaaaatactacgggccgctcggcgaggcggcggcgaaggcgatccggcaaggcgacgcgccggcgttcgtcgccgcgtggcgcgcgatgatcgacgcgcgcaagcgcgagcgttacttctggtactggctgcgcgccgaatacctgacgctgttgccggccgcggtggctgtcgacatctggaacgcggtggcgggcgaacacagcacggcgggcgtgaacctgctgatggcgaccttcggcctgcccgcgttgcccggcctcatcgcaaccgtgcgcaacaagccgaccgagaatttcggctacgcgctgaattacggcgccgtcgaatgtgcgccgatcgcggcccgcgcgttcgcgaagctgaagaccttgcgcgacgacggccgtgcgtggctgctgaagtttccggagcatgcggcctgcggcctgatcgcgccgtcgctcggcaagccgggcgaagcgcgcgactgcgccggcgctgcgctgcgtttgctgcaggcgaacggccacgaggcgttgctgatcgacgtcgcctcgcgttatgccgacgacgcggtgccgcaagcggtgcgcgccgtgctcgacgagagcccgctcgaccgtttcccgaccaagcgcagcaagctgcccgaattctggcagccgcgcggctggcgccggccggtgctgaagaacggcaaggcgctgccggacgacgcgctcgactatctcggccagatgctgacgttcccgaccggtgaaggcgtctacggcggcatcgacgtcgtgaaggacgcgtgcacggcggagtcgctggccgatttcgcgtgggactgcttcaacgcatggctcgatgccggcgcgccgggcaaggagggttgggcgctcaccgcgttgggcctgttcggcaacgacgacaccgcgcgcaagctgacgccgctgatccgcacgtggcccggcgaatcggcgcatgcacgcgcggcgaccggcctcgacgtgctggcgtcgatcggcagcgacgtcgcgctgatgctgctcaacggcatcgcgcagaaggtcaagttccgtgcgctgcaggaccgcgcgcgcgagaagatcgatgcgatcgcggaagcgcgcgggctgtcgtccgaggaactggaggaccgtctcgcgccggatctcgggctcgacgaacaggggacgatgctgctcgacttcggtccgcgtgcgttccgggtcggcttcgacgagacgctcaagccgtatgtgcgcgagaccggcgccgacggcgtggccggcgcgcggctcgcggatctgccgaagccgaagaagaccgacgatcccgtgaagggcaaggaagcggtcgagcgcttcaaggtgctgaagaaggatgcgcgcaccatcgcgagccagcaggtcgcgcggctcgaggtggcgatgtgcgggcgccgccgctggacacccgaggtgtttcgcgcgtttctcgccgagcatccgctcgtgcgccatcttgtccagcgccttgtctggggtgtgtacgaagtcgacgacggcggcaacttcggcggcacgctgaaggcctgcttccgcgtggcggaagacggcacggcggcgacggccgacgacgacgcgtttacgttgccggagggcgcgacgatccgcatcggggtgccgcatgcgctggagatcgcgccggccgatgccgccgcattcgggcaggtgttcgccgactacgagctgctgcagccgttcgcgcagctcggtcgcgacgtgtaccggctgaccgacgacgagcgcaacgggcggcagctcgaacgctggaagggcgtcaaggtgccgaccggccgcgtgctcgggctcgtcaacaagggctggcggcgcggccaggtcgaggatgccggctgcatctggtatttcacgaagccgctcggcgcgggcaaggtgatcgaactgtcgctggacccggggatcttcgtcggcgcggtcgacatgaatccggatcagcaactcggcgcgttgcaggccggttcgccgtcgaactggggcagcattcgcgagcccgatgcgctgtcgacgctcgacgaaatctcggcaagcgagttgatccgcgatctggaggggatgcgggagtaacacgtgacatctgggttgatgcgtcggggcgaacgggtgtggcgatcgcgggtgtcgacagcgcccggtttctcgcaaatcaaactgatcgggtgtggtgcagattctcgttctccggagatcaaatgcggaaaccagagcagggacgtggcgaatgcgtaagcggaggacggcgtctcccgcgcacgcaatagcgtccagatcccgagttccggaatgcgttgccgatccggcgtgattgccttgccctgcggcgtgacgccctgacgctccatttgaagccggcgcacccagcggcgcagtaccgtctcgccgacgcccaccgagcgactcgtttccatatggctatagccctggtcgagcaccagccacgcggtttgctgtttgaattccggtgaaaacgtacgacgtcgtttggcatctgacggcgcatccatccgagtcgggcgatggcgacctccgaccagtcaaggggaccggatctaccgtgaagacatgacctttccagaatcaactggggcattcaatcgcggcatgcaagcctggaatcgataataaaaataagtaaatatcctcaaaatatcgggtttgcccgatggtgcggtatcgtacaaagggagtccgaaaagtgaccgatcattggttcgtcggattcggcgctgtaaaaatctcagaggtgaaatctgatgtcgatcatccaatcaacgacgtttagctgattagatgaacggcatttagcacgcaattattatcgggcgcgggctcgatcgggcagtcgttctcgttgaaatttcgtactccgtggcatgcgggcaccgcgacatccatgcgcggaagcacttgcacgtccattgcccggcgtctttcagtggggcgtccgccgaggcgatggctgctcgcatatcgccgctgaatggccgacggagaaaggccgatcgattcatctcggtcggcgtggttttatgcgcttttgagcaggattgaatgcattggtttgattttgctcgagcgatggatgcgccgagtcgttaaaaagtttaaatgtatttaacgtgttgatctgcgccgcaattgcggcgttgttcgatgccccgctagatggattatctagcattttgaaactggagaaatgcaatgcaagaactgaatcaacagcaaatcgcacaagtttccggcggctactacagcggcccgggcatcccgtccgcgttgggcaacatcatcgaatggggcggcagcaccgcggagagcatcggcaatgcgctgacgttcggcatcttcgccgcaccggtcaagcaggcatacaacatcggcgagacgatcacgaccgccgcggtgaacctgctggacggcctttcggcggcccgcagtactgagttgcctgcattgaggcgacgcggtagccgccgcgtctcccgatgatggaactgacgatccggtatgcacgggtcttctttataccggatcgcttttgcctgttccgacgcgtggaagcggaatggacgccgataccgatattgggcgacatgttgtttggcgacacgttggtgaaaatggagttcggtctctttcgttctgaagcggcacaggctcggcgcatgcgggtgctgggcgacatcgtgctggtgcacccgctgtccatgacgctgctgacggtcgtcgcgatggtcatggccacctgcgtggtgctgttcttcgcgttcggtacgtatacgcggcgcacgacggtctccggcgtggtgatgccggatgcggggctggtcaaggtctatgcattgcagccgggcatcgtcgtcgagcgcgacgtgaaggaagggcagcgcgtgacgcgcggacagacgctctataccgtatcgaccgacctgcaaagcgccgcgcaaggcgcgacgcaggccgcattgatcgcgcaggcgcggcagcgcaaggcgtcactgctcgcggaaatggacaagacccgcagcctgcagcaggacgagcgcgacacgctgcgcgcgaagatcgggaacctgaagggcacgctcgcgcaaatcgacgaccagctcgcggcccagcggctgcgtacctcgatcgcggccgatggcgcaacgcgttatcgcggcctgctcgcgcaggattacatctcgaaggaccaggcgcagcagcgcgaggccgacctgctcgaccagcagtcgaagctgaacgggttgctgcgcgaccgcgcatcgacgctccagtcgctcaccgaggcgagcaacgaactgtcggggctcggcttcaagcagcagaaccagctcgcgcagatcgaccgaaacgtgatcgacgtcgaccagaacctgatcgaaagcgaggcgaagcgccggatcgtcgtcaccgcgccggaggcgggcatcgtcacggccgcgatcgccgacgtcggccagtcggtcgatacgtcgcggccgctcgcgagtgtcgtgccgggcggcgcgcgctggcaggcgcacctgttcgtgccgagcacggcgatcggcttcgtgcgggtcggcgagccggtgctggtccgctatcaggcgttccctatcagaaattcggccagtacggggccacggtcgtgtcgatcgcgcgcacggcgctgtcggcggccgaactcgcgaacgacggtggcccggcggcgacgcccggagagggcgcgacgcgaccttctaccgcgtgatcgtcgcgctcgatgcgcagcacgtcaccgcgtacggcgcgccgcaaccgttgcaggccggcatgacgttgcaggcggacatcctgcaggaacgccggcgcttgtacgaatgggtgctcgagccgctttacagcctgaccggcaaactctgacgggcgcacgcatgcgattactcgatcgactctcgttcggcctcggccgcaagctgccgatggtcctgcagaccgaagcggccgaatgcggcatcgcgtgtctcgcgatgattgccggctatcacggccatcacgtggatctcgcgacgctgcgcacacagtttccggtctcgctgaagggtgcgggcctcgggcgcgtgatcgagatcgcgcagcgcctgtcgctcggcacacgtgcgttgaagctcgacatggcgcagctcggccagttgcgcctgccgtgcctgctgcactggaatttcaaccacttcgtcgtgctggaggcagtgaacggcaagaccgcgacgatccacgatccgtcgcacggcattcgcaaggtgtcgctcgccgacgtctcgcgcgggttcaccggcgtcgcgctggagctgtggccgaacgccggcttcgcgccgcgcggcgcggccggcggtcaggctgcgtgaactgctgggccccgtgtcggggttgtcgcgttcgctcgcgcagatcctggtgctggcgatcgcgctcgaggtcttcatgctcgtgcagccgttcttcctgcaatgggtgatcgacgaagtgatcgtcagcgccgatcgcgacctgctgacggtgctcgcgctcggcttcggcctgctgctgctgatgcagcaggcgaccggcgcgattcgcgcatgggcgctgatgtatgtcggcgtcacgctcaacatccagtggcgcgcgaacgtgttcacgcatctgctgagcctgccggtgcgctattacgaacgccgccatctcggtgacgtcgtgtcgcgcttcggctcgatcgacacgatccagcagacgctgaccacgtcgtttctcggtgcggtgatcgacggactgatgacgctcgtcacgctggcgatgatgttcgtgtacagccgcacgctcggcctcgtcgcgctggcgacgatggcgttgtacgcgctcgtccgatggatgtggtacggcccgttgcggcgcgcgacggaggatcagatcgtgcacgccgccaagcagcagagccatttcctcgagacggtgcgcggcgtgaagacgatcaagctgttcaaccgccagacggagcggcgcgcgagctggatcacgctgctggtcgagcaggtcaatgcgagcctgcacgtgcagaagctgattttctatcagcagctcaacgggctgctgttcggcatcgagaacgtgctggtcatctggctcggcgcgcggatggtgatggacggccagttcacggtcggcgtgctgatggcgttcaacgcgtacaagagtcagttcgacagccgggtcggcagcctgatcgacaagtatttcgaggtcaggatgctgcagttgcagggcgagcggctggccgacatcgtgttcgcggaagcggaacccgacgcgagcctgcgcagcgtgccgggcgaagcggactcgctcgacccgagcatcgagatcgacgggctgtcgttccgctacgcggacggcgagccgctggtgctggacggcgtcaatgcgacgatcgcggctggcgaatcggtcgcgatcgtcgggcagtccggttgcgggaagacgacgctgatcagcgtgctgctcgggattcacgagccgacgggcggcgccgtgcgcatcggcgggctcgacgtggccaggctcggcatcgagcggctgcgcgcgctggtcggcacggtgctgcaggacgacgtgctgttcgcggggtcgatcgcggagaacatcagcttcttcgacccggaagcggatccggactgggtcgctgaatgcgcgcgcatcgcggccgtgcacgacgacatcgccgcgatgccgatgggctacaacacgctcgtcggcgacatgggcaccgtgctgtccggcggccagaagcagcgcgtgctgctggcgcgcgcgctgtacaagcggccgcgcatcctggtgctcgacgaagcgacgagccatctcgacattcagcgcgagatgcaggtcaatgcggctgtcacgcagctcgcgatgacgcggctcatcgtcgcgcaccggccggagacgatcgcgtccgcgcagcgcgtcatcatgctgcagggcggaaaggtcgtgctcgatcagtcgaccgcggcgatgcgcgcggcggtcgcggcgaagtcgcgtggcggcgagccggcctcgacccggccggcggcgcacgatgccggtccggtacagccggtggcggggcgctagatgatgaagcgacccttcgccgtcgtgctggccgccgttgcgctggccgtcgcgctgcccgcgggcgcgcagatgctcgacgtctatcgcacgcgcgacgacgtcgcggcgacgcaggccgggtcgatggcatcggccaccgcatgcggcgcacggcgcctcgacgaccggccgatcgcgctcgaggacgcgatcctgctcgcgatctgctcccatccgcaactgagccgcacgtgggcggacgcacgcgcggcgacggccgaggtcggcgtgtcgaaggccgcatacctgccgacgctgaacgcgacggccggtatccagcgcgacaacgtgaacacgacctatacgggcggcttttccggcgatcagcgcagcaccagccgctacggcatgctcaacctgagctgggtgctgttcgatttcggcaagcgcggcgcgaacctcgaccgcgcgcgtgcgttgctgcgcgcggccaatgcggcgcacgacgacgcgttgcagagcgtcttctacgacgcggcgcaggcgttttatgcgctgcgcgacgcgcaggcggcgctcgaggcggcccaggcggtcgaacgtgccgcgcaggagagcctggccgaagcaagcgcgcgacacgacggcggcgcaggcacgctcggcgacgcgttgcaggcgcagacgacctatcgcaaggcactgctcgatcgcgtgagcgcggagggcgacctgcagaacgcgatcggcacgctcgcgacgacgctcggcgccgacgccgacacgccgctgcgcatcgccgatgcggagccgtcgcccgatcgcgacgatttcacgcgcggcgtcgcgaacctgatcgccgaagcgaagcgcgatcacccgaagctgatcgccgcgcgcgagcggctcgaagcggcgcgcgaccagatccgcgcggtgcgcgcccagtcgctgccgacgatttcgctgatgggcagcctcacgcgcaacaacccgtcataccagcagcagccgtcgctgttccagttgcagagcagtcacagcaactcgatcggcatccagatttcgattccgctgttcgagggcttcgcatccgggtatcgcatcgcggaggcgaaggcgcaggccgatgcgcaggaagccgacgtgcgcaataccgaactcaaggtgtcgctcgacgtgtggaagagctaccagagcctgcagaccgacacgacgaacctcgacaactcgcagcatctgctggacaccgcgctgcattcgctcgagatcgcccgcggccgctacaaggccggggtcggcacgttcactgaactgctgaatgcgcagtcggcgctcgcggatgcgcgccggcagcgcgtgctcgcggtgtcgaggtggcggaccgcgagactgaagctggccgagagccttgggagattgggattatggaacgacgcgggttgaacggcaccgggccgaacgcgggcgacgcgcaagcgcacggctgcgcgttcctgttcccgggacaaggggcgttctacgcgggcgcgttgcggcaactcgggcacgaacatcgcagcgtgcggcagacgctcgacacgatcgacgcggtcgcgagcgagcggctcggccatccgctgaccggcgcgctgtggcgcgacgacgcggggctcgatacgtggctgcgcgacgcgcccgacctgttgcagctcgggatcttcggcgcatcggtcgggatgttcggcgtgctgcgcgaacgcggcgtcgtccccgacctgctgatcggacacagcttcggcgaaatcgcggcgctggtatgcggcgggatgtattcgatcgagcagggcgcgcgtatcgtgtgcgacaggattgcatcgttgcaggccgcggcaccggccgacggcatgatggccgcgatttcggccggcgccgacgcgacactcgcgctgatcgacgcgagcgcgctcacgcacggggtgcgcaacgtctgcatcgcggtcgagaaccatgcgtcgcagaccgtcgtgtccggcccgcgcgacgcgctggaaggcttcgtctcggcctgcgcggcgcaaggcgtgaccgcgcagacgctccggtctccgtacggctttcatcatcccgacctggccggcgcgcgcgcgcagttcgccgcgcggcttgccgcatatcggcccggcgcgctcgcgatcccggtgtattcgccgatcctcggccgccgctatagcggcgccgacgatcccggatgcggctcgcgtcgcatttcgtgatgccggtgcgctttgcggacgcgattcgcgccgcgcgcgcggacggtatcgaccgctacgtcgagtgcggcgggctcaatgcgctggcgcgcatcgtcgtgcgcatcgtggggccgggcgcggtcaggacgttcggcggcccgtcgaacgtggcagaggaatcgagcgtcgtcacgacgatcacccgttatttccaggaggacaccatcatgaaagacgatattcgcatcggcaacgccggctccggcttcgacgcgttctggcacgcgcgcggaccgcacatcgtcgactggctcaagggcgaactgcgtcacgcgttcgacgcggcgggcgcggtgccggcaggcgccgcaccgacggcgacgccgttcgcgccgcagcccgagccgatcctcgcgcccgcgccgcgcctcgcggcagtgggcggggccgcgctggcgccggttccggcgccggcggtgccgcatgcgccgggtgagccggtgacggcgcccgcggcggttgcagcggcgcggcccgcgcacgtgccgcgcgagcggctgttctcggagctcgtcgatatttacgcgcaggcgatggaatatccggccgaggtgttctccgaatcgatcgagctcgaagccgaactcggtatcgactcggtcaagcaaaccgagatcatccagcgcatcacggcgcgctacgcgttgccgccgctgcccgccaatttccgcagcggcgacttcaaggcgatggggcagatcgtcgatttcgtctacgagaaccaggaaaggcgcacgcctgacggccgtgggccgaaacgttggtcggcagggggccctgcccgtaatgacaagttctcgataggcaggcgatccatgtcgaataccagcatgcgcggcaagctcgttctcgtgacgggcggtgcgaaaacgtgggcaaggcaatctgcaggcgattcgccgagcagggcgcgcacgtgatcctgaatttcttccattcgctcgacgcgtcgaaggagacggccgaggaactgcgcgcgctcggcgcgaccgtcgacgtgatccgtgcgtcggtcgcgcagcagacgcaggtcgaccggatgttcgacgagatcgaacggcgctacggccgcctcgacgtgctcgtcaacaatgcggcgtccggcgcgctgctcggcgtcgacgagatcggcgccgagcatttcgatcgcgcgctcgacaccaacctgaaaggcgcgttctggtgcgcccgccgcgccgcggcgctgatggcgcgttcgggcggcggcgcgatcgtcaatgtgtcgtcggtgggcgcgacgctcgtacccgcgaactatctcgtcgtcggcaccgcgaaggcggcgctcgaatcgctgacgcgctatctcgcggtcgagtatgcggggcgccagatccgggtgaacggcgcatcgtcgacgctgatcgacggcgacgtcgccgcgcagtttccggacccggagaacacgaagcgctcgagcatcgcggcgacgccgctgaagcggctcgcgcgcgcggaggatctcgccgatctcgtcgtgtttctcgcgtcggatgccgcacgctggattaccggacaggtggtcgtcgcggatggcgggttgtcgctgtgcagcgagggattgtcgccgcgcgccgaatgggcgaacgccgggcaggatgcgggcgccgccgcggccgtcgcgcaaccggccgcgccggccgacgacgcatcggagcgcgacgcaccggacagcgacgacatcgccgtggtcggcatggggctcgcattgcccggtgcgagcgatccggacgcattctggcgcgcgctgctggacggccccgaactgttcggcaacgtgccgccggatcgttgggactaccggtcgttctactcgccggatacgtcggcggaagacaagagctaccagtcgcgctcggtcttcatcgaacagttcgagccgtgctcgacggtgcgcgccgaactcgacgcaggcaccgcgccgcgcgagctcacgacgccaggctgcgccacgcactgtgccaggcgctcgacggcgtgacgctgcgcgatgccgaccgcgtcgcgttcctggtcggctacacggcggacggcagccagcatctcgaggaaggcatggtgctggccgccgcgcgcgaacgcctgaacgcggtgctggccgacgcgggcgtcgacgcggccgagcgcgcgcgccgcgtggccgcgatcgatgcggtgctgagcgcgcgttatgcgcgcggcgcgggcgatcttgcgtcgttcttcccgcatcgggtcggcctgaatgcgatgaaaggcgtgctgccggacgacgcggagtacatgatggtcgacaccgcgtgttcgtcgtcgctgtattcgatcgatctcgggatcaaggcactgctgctcggcaagcaggacgtggtcgcgtgcggcggcgcgttcgcgctcgcaccgcgcggctcgatcctgttttcgaagctgcacgggctgtcgcgcagcggcgaggtgcggccgctcgatcgcaactgcgacggcgtgctgttcgcggacggcgcgggcgtcgtgatcctgaagcgcctgacgcgcgcgcgggcggacggcgaccgcattctcggcgtgctgaagtcgttcggctcgtcgtcggacgggaagggcaaggcgatctacgcgccgaattcggccggccagcgcatcgcgatcgaccgcgcgtatgcgcgcaccgcgacggtgcccgccgacgtcgactgggtcgtggcgcatgccaccggcacgccggccggcgatctcgccgaattccagagcctgcgcgatgcgatccggcgggatcgcccggtgcaggtgacctccaacaagtcgctggtcgggcataccggctgggcggccggcgtcgtatcggtgatccaggtgctgctcggtttgcgccatcaggtgattccgccccagcatcgcttcagcgaaccgccgccggaattcgatctcgacggcacgaacctgaggatcccggtggcaccggtcgaatggccggcccggcgcgattcggcacgcgtcgcggcggtgtccgggttcggcttcggcggcacgaacggccacctgatcgtgtcggagtaccgcgccgatctgccggccggcggcgcgagcggccgcttccagcgcgaaccgctggcgatcgtcgggtggtcggcgaagtttcccggtctcgacggcgacgcacaggtcgaggcctggctgcgcggcgaaggccgcgcgccggacgcgagcttcgggatcggctatccgctgccgagcttcgcgcgcgtgaagatgccgccggccgtgctgcgcgcgctcgatcgctgccagctgatggcgctcgatgccgcgcacgacctgcgcgaacgtctcggcacgttctggggcgagcatgcggacacgatcgggctcgtgatggggcacatggggcccacgcgcaacgcggcgctgtatgcgagccgctgctatctcgacgacatcgcggcggcggtgctcgacgcgacgcggccggacgagcgtgcggcgaccgaacgcctgctggacggcttgcgcgaggcgacgcagcggctcgtcgcgccgaccaccgaaaactcgtttcccgggatgatgccgaacgtgatcccggcgcgcgtcgcgaattatcacgatctgcacgggatgaacatgacggtggacgcaggccacgcgtcgacgctcgccgcgttcgaggcggccgagcgtttcctgtgcagcggcgagctcgacatggcgatcgtcggcgggatcaacggcaacgccgcggaggaggtgggtccggcattcgggctgccgctcgcggagggcatcgtgctgttcgcggtaacgaccgtgcggcacgcgcaggccgaagggctgccggtgctcgcggtggtcggcggcggcgacgcgcgggccgcggtcgagccggccgcgccgtgcgatgcgacgggccgcgcagtcacgtatgcgggcgccgatgcggcgatcgacgtgctgcgcgcgatcgttgcgcgtacccccgacgtgacgctggcgcgcgacagcggcggcgaccggccgcgctatgcgctgcacgtcgcctgcgagccggccgccgcgcaggcggccgccccgcgcgaaccgcaagccggagccggggccgtgccggtgcaggccgtgcagccggcgcctgcgccggttgccgcgcccgtcgggcccggtacgttgctgcccggcgcattgcgccggaccggcgtcgcggccgacggcgagccgctcggcgtcgcacgataccggatcgaatggcgagatgcgccgtggcggcccgcggggcggtcgacgccgttcatcgcgccgcgttgcgtgatcgtcaccgacctgccggaagcgctcgccgcgcaggccgatccgggccccggctgcgtggtgctgtcgacgcgtccgttcgccgcgaaccggccgggctggcactggatcgagcgaatcgacgaaacggtactcgccgggctgcccgacgacatcggccacgtacgcgtgctgacgtcgctcgatgccggcacgctcgcgccgggcgccgcggcgccggccgcgcccgcgcggctcgcgctgcacgatctcgcgttcctcgcgatcaagcgttgccatgcggcgctcaagcgcgacggcagcttcgtcgtgctgctgctcgatgcgctcgcgggcgaggtgccgcatccggatgccgggctctacaccggtctcgtgaaggcgcttgcgatcgagatgccggaagcgcgcccggtggccgtgctgaccgacgcccgctcgctgcccgacgcgctgcgcgatgccgagcgcgaaagcggcgcgcaacactggctgccggtcgtcgcgctgggcggcgggcgtcgccgcacgccgcgcgtgatcgaggacgcgggcgagctgcgcgcggacgagcgcctggcgctcgggcccgacgcggtcgtcgtcgcggtcggcggcgcccgcgggatcaccggtgaactgatgaagacgctggccgcgcatgtgcgtccgacgctgtacctgatcggcagcagcgcgctcgacgaggtcgatgcggacctgctcgcgatggacgacgaggcgttcgcgaagagccgccccgattacatccgccagcagaaggcacggcatccggagcggccgctgccggcgatcatccgcgcgttcgagcggcgtgcggacgcacgcacggcgtgcatgaatatcgaggcaatgcgcgcattcagcggcgcgcatcgcgtgacgtacctgcgcgccgacgtgctggaccccgacagcctgcgcacggccgtcgacacgattttcgcgcgcgagccgcgcgtcgacctgctggtcaacgcggccggattgaaccgttccgcgtcggtgctcgtgaagtcgctggacgacttcgtcgcggtgcgcgacatcaaggtgcgcggctactggaacctgcgcgacgcgttcggcgcccggcagccgcgcctgtggtgcaacttcgggtcgttcatcggcctgacgggccaggccggcgaaaccgactacgcgtcgggcaacgacttcctgaacacgcaggcgtcgtatcaccgcgcggcgctcggccacgacgaattcacgatcggctggacgctgtggcgctcggtggggcttggctcgaatccggtcacgcgcgcgtttctcgagaagagcggcctgttcacgagcatgcgcaccgcggaagggcagcatcatttcatgcgcgagctcggtctcggcgagcgcgcggcgatgtccgtgcatctgggcgaggccgagcgacgggcgatcgagacgcacctgcccggctacttcgatctcgacgaagctgaagcggtgccccgcgtcgccacgccgcgcgatccggatttctatctcggccgcgagctggcgcgcacggacgacagcgtgaccttcgagcgggtgttcgacctcgagcgcgacgcgtacctgcagcatcacgtcgtcaacggctttccgacgctgccgggcacgttcgtgcccgaagtggccgccgaagccgcgctgcggctcgtgccggggctcaaggtcgtcggattcgcggatgcggcgttcctgcacttcctgcgcgtctacgatgcgaagcggccgagcgtgaagcgcatccacgcgaggatcgccgcgcgcgacggcgacgccgtgctcgtgcacgtgcggatctccggcgacgtgctggcgcccggcggccaggttctcgtgcgcgacaagccgcacttcgagatcaccgtgcgcctggccgcggcctacgcgccggcaccggtatggatcgaaccgccgggcgggacgtttgtgcccgtcgccgatccgtatcacttcgacgcggcgcctgtgagactgaccggcatgttcgtgtcgacgaccgacaccggcatgagcgaaacgggcaagcaggcgcgcttccggctgaacgtgccggacggcgatccggtgttctcgcgcttcgtggtgccgagcatcctgctcgacgggctcgcgcgcgtggcggcgctcgatcatgtcgccggcgactacatcccgctcgcggcgccgatgtcgatcggccgcatcgatctgtacgaagccggcaacgactgcgagctggccgcccgccacgcgtcgatcgcgctgcgcgtgacgccgcgcgccttcgcgctcgaagggccggcgagcagcggcaaccggttcgtcgcggtgcgcccggacggccgcatcctgatgcagatgcgcgacgtgacgggcatcgtgaccggctacgtgcaccgcgtgaccggcgcgttcgccacgcgcggcgagatcgacgcgcggctcgccgcgaacgcggcttccgagcaggtgtcggcatgagcacgaagcgtctcgcgcccggcccgcgcggcagcgtcgtgatgggcaacctcgcggaatacaagcgcaatcccgtcacgatgctgctgaagcttcagcagcagtacggcgacatcgcccgcaaccggctgggcctgttcctcacgcatgcgctcgcgcatccggacggcgtccagcacgtgctgcaggacaatcaccgcaactacgtgcgcggccgcttctacgacaacttcaagatgttcttcggcgacggactgctgacgacggacggtgagttctggcggcgtcaccggcgggtcgtgcagccgctctttcaccgcaagcaggtggaatcgcatacggcggccgtcggcgacgcggcgctcgcgctcgtcgagcgctggctgaagcggcccgcgcatgcgccgttcgacgcggtcgaggagatgatgcgcgtgagcctgcgcatgctcgggctgatgctgttcaacgcggacatctcgcggcatgcggacgaggtcgggccggcggtgcgcttcggcatcgaggcgatgatgccgcagggcaacatgaacgatttcgtgccgcgctggatgccgacgccgttcaaccgccggatcgcacgcgcgcgccgcgggatcgacacgatcgtcgatgcgatcgtcgccgagcatcgcgcgggacgctgcgaaacgagcgacgtgatcgcgctgctgctcgccgcgcgcgaccccgacacgggcgcgccgctgaccgagcgcgaggtgcacgacgaggtgatgacggtgttcctggccggccacgaaacgaccggcagcgggatggcgtggggctctatgcgctcgcgcagcatccggacgtgctgcgccggctgcgcgaggagcttgatgcggtgctcggcggtcgcgcgcccgcggccgacgacatcgcgcgcctgccgtatctggtgcagaccgtcgacgagatcctgaggctctatccgccgatctggggcttcacgcgcgacctggtcgacgacgacgagatcggcggttatcacgtgccggccggttcgtcggtattcatgtcgccgtacgtcacgcatcgtcatccggcgctgtgggccaacccggacgcattcgatccggaaaacttcggatcgcacgcgccgacgcggcacaagtacgcgtactttccgttcggcggcgggatgcgcaagtgcatcggctatcagaccgcgctgctgcagatccgcgtgctgatcgcggtggtcgcgcagcacgtcgatctgagcgcggtgcctggtcgttcgctcgacacgggcgcgacgatttcgctgcgcccgcgcgacggcattcagctggtcgcccggccgagatcgcgcgagcgcacgagcgccgcgcctgccgggcgcgatgcgcgcgtgccggcttcgcgcggtgcggcgtgtccgttcacgggtgcgccggcagcgacggcagcgacggccggcggcgagcgggcggcaagcgtggcgacggcggccgcgcccgggcctgccgtcgggccgacgctggcgcccgacgtgctggcgtttctgcagcgcgacgcgacggcatccgaagcacggcgtgacgccggcgtcgacacggacgaagcaccgacccaccgcttcacgtggcggccggtcgagatcgaaccgctgccggaacggccggcggccgaactgagcggcaagcggatcgcgatcgtcaacggcctcggccgcacggtcgagcgcgtggtggcggcgcttgcgcgcgcctgcgcgaagccggcggtgttcgccccggccgacggcgtcgatccggcggcggccgcgaacacgttcgttgcacagtcgggcccgttcgacgggatcatcgatctcggcgtcgaggcgccgttttcgctcgacgtgcgcgatcagtgggaagcgccgctgcgccgcacggtcgcgttgctgcaggcgtgctacggcgactgggtgcaggaggaagcgacgtcgcggctgttctatctcgcgctcacctggcaggacgggctgatgggatacggcgacgatgcgctcgtgcagccgctcggcggattgtgggcggggctcgcgaagacgctgccgcaggaactgccgaactgcaacgtgcgcgtgctcgacatcgcgccggacgaaaccggtcgcgtcgacgggttgatcgcacgcgagctgtatcgctgggggcgcttcgaggtcggccatcgcggcgggcgccgccacacgctcgtcgcgacccgcgacgacctgccggcgcaagcggcgcccgactgggggcccgacgacgtcgtgctgttctcgggcggcgcacgcggcatcgggttcctggccgcctgcgagatcgcgaagcggtatcgctgcacggtgatcgtcaccgggcgagacgcgccgccggccggcgacgagccgtggctcgcgctcgacgatgcgggcttcaggcgctacgggctcgacctgctgcgccaggcgacgccggagcggccgcccaaggcgatccggcacacgctgcagcaactcgaacggcgccgcgagctgaaggcgtcgctcgacgccgcggccgcgctcggcctgccggtgcgctaccgggtatgcgacgtgaccgatgcgaacgccgtgcgcgcgctgtgcgacgtattcggcgcgcggttgcgcggcgtgatccataacgccggcatcgaccagccggtgcggttgccgcgcaagtccgcggacgaattcgtcggcaccgcgcgcgtgaaggtgctcggcttcatgaacctgtacgcggcggtgcgcgagcggccgcgtgtcgactgcttcgtcaacgtcggctcgctgaccggccgctggggcggcatgacgggcgagaccgactacgcggccgcgaacgaggcgctcgcgcggctcggctggtgggcgcgccgcgatgcacccgggcgcaacgtgaagacgctcgtgtggccgacgtgggacggcgtcggcatgatcacgaacctcgccgtcacgcggcgttatgtgacgccgatgcgcatcgccgacggcgtcaggcactggcttgcggaactcgcgcagccggccacgcccgcggcgtccggcggcggcgaaccgatgtacatgggcgccgtcggccgtgcgctgacgccgatccagctgcgcggcttcgatgcggtcgacggcttgccgaatctcggcgaactcgcgacacgccggcaccacgcgggcgagccgcggcgattccggccgttcgcgttttctcgacgcgctatcgtgcggccaacgcgccctatacgcgcgcattccgcttcgacggccgtgcggcggcgccggtgtcgctgctgctcgagcacgcgcgcgtcgtggccgactgggtggcgccgcccgatggcgagcgcgcgtacctgcatgaagccgtcgacgtgacgatcgcgctcgatgcgctcgccgacgcgctcgacgcccacggcgatctcgcgctcgacaccgacgtgaccggccgcacggccggcgacggttggcacgtgacggtgcggtgcgcctcgctcgccggccgcgtgctgctcgatgcgacgttcgtgtaccgcagtcatccgcccgcgggtgcgaccgtgccgctgccgcacgacgggcaggacgatgcggtccggccggccacgtgcgcgatctggcgcggcgacctgctgcccgacgcggactggcgcggcggcatcgcgcaggtcagggccgccgacgccgacgcgttgtggcgcgcgccgggcgagggcgacgcgcgcggcgcggcgccgtgcccgcagatatggctgccggtcaatcatctggagaacgtgttgcgcgtgctgctcggcgcgtggcccgaagacggcgaaccgccgcgcacatggcacatcggcggcatcgcgttcggcgccgcgcgtgccgccgacgccgaattgctgctgtgctacccggacggccgcttcgcgatcgccgatcgcggcggcgcatcgatcgccgatctgcgcgatgcgcggctggccggcgcgaccggcacgcaggccgcggccgggccggttctttgaacggaaagggaaatccaccatgacggagcgcaacgacggcgcgcggtactgcatcatcggcgcgggcgcggcggggatcaccgccgcgaagaacctgctcgaggccggaatcggcttcgacgtgatcgagcgcgaggacgacgtcggcggcaactggtattacggccggccgagcggcgcggtgtatcgctcgattcacatgatcagctcgaagcggttttcggagtacaccgactttccgattcccgacgactacccgacgtatgcgcgcggcgaccaggcgctcgcgtacctgcgggcgtacgcgcggcgcttcggcgtgtacgaccggatcgagttcggccgctcggtgctcgagatcgcgccggtcgccggcggctcggggtggcgcgtcgagctggaccgcggcgaagtgcgcacctatcgcggcgtgatcgtctgcaacgggcatctgtcgcatccgcaactgccggactatccgggccgcttcgacgggctgcagctgcattcgtcgcaataccgcacgccggagatctttcgcgaccggcgcgtgctcgtggtcggcgcgggcaattcgggctgcgacatcgcggtcgaggcgtcccaccatgcgcgcgcggtgttccacagtacgcggcgcggctactactactggccgaaattcctgttcgggataccggccgaccagtgggccgaatggccgctgcggctgcgcatgccgctgtgggcgcgccgcttcttcggcgagcggctgctgcggctgacgacggccgggcagccggaggactacgggctgcgcaagccggaccacaagctgttcgagtcgcatttcatcatcaactcgacgctgttctaccacctcggccacggcgatctcgatgcgcggcccgacgtgcgggaactgaagggcgatcgcgtcgtgttcgccgacggccgcgaggagccggtcgacgtgatcgtctacgcgaccggctatcgaccgagctttccgttcatcgaccaggcgcatctgcaatggcgcaagcagcagccgtcgctgtacctcaacatgttcgacgcacagcatcgcgacctgttcttcatcgggctgttccagacgtcgaccggcaactggccgctgatggactaccaggcgcagctgctcgggcgctatctgcatgcccgcgacgcggcgccgcgcaaggccgcgcacatcgaccggctgatcctgcgcggaaagtcggactggagcggcggcatcgcgttccatcgcacgccgcggcacgtgatcgaggtcgagcattttgcctaccggctgcagttgcagcggctgatacgcggcctgccggccgtgcccggcgcggcaggcgcggcaggcgcggatgcgcgcgccgcgcaggaagcgcctgcggcgcccgtgcgcgcgggaggtgcgtcatgagcctcgtgaacgtcgaacacctgtcgaagacctacctgctcgacagcgtgcgcgtgaccgggctcgccgacgtgtcggcgacgctcgaggccgggcgcttcaccgtgttgagcgggccgtcgggcagcggcaagacgacgctgctgaacatgatcggctgcatcgaccgccccgacagcgggcgcgtgacgatcgcgggccacgataccgcgtcgctgtccgacgatgcgctgtccgatttccgcgcgcgccatgtcggccacgtgttccagaccttcaacctgctgcccgtgctgtccgcgtacgagaacgtcgagtatccgctgctgatggcgggctggccgccggcgcggcgcgcggcgcgggtgcgcgacctgctcgacgcggtcgggctggccgacaaggcgcggcaccggccgagccagctgtcgggcggccagcgacagcgggtcgcgatcgcgcgggcgctggcggccgagcccgcgatggtgctggcggacgaacccaccgcgaacctcgacagcaccaccggccacgcgatcatcgcgctgatgcgcacgatccagcgcgagcgcgacgtgtcgttcatcgtgtcgtcgcacgacccgcaggtggtgagcgtcgccgacgaggtgatccggattctcgacggccgcatcgtcggccgggaacgggctggcgaaggcgcggcggcgcaggaggtgggccgatgatccatacgctgatgctcgcgctgcgcaacctgcagcgcaaccgccggcgctcgctgaccacgctgctcgcgatgatcgtcggcgtcagcgcgatcctgttgttcggcggcttcagccgcgacatcacgctcgggctgcaaaccgacttcgtgcagcgcagcggtcacctgcagatccagcggcagggctattacctgtacggcacgggcgatccggccgcgtacgggatccgccgctatgcggcgctgatcgacctcctgcggcgcgacccgcagctcgcgccgatgctgcaggtcgtcacgccgacgctgcagttcggcggcatcgccggcaatttcgcggccggcgtgtcgcgcaccgtgatgggattcggcgcgattcccgacgaccagtaccggatgcagcagtggaacgcatacggttttccgctgcgcccgcgggcgttcgcgctgcgcggcagcgccgacgatgcggcggtggtcggtctcggcgtcgctcgcgtgctgcacctgtgcgggccgctgcacgtggcggattgccgcgatgcgccgccgggcccggccgcgcccgccgccaccggcccggacgcgagtgcgccggccgacgtgctcgcgctcgcgcagggcgaggccggcacgcagccggccggcgacggcgcgacccacatcgaggtgctgaccgcgagcgcgggcggcgcgccgaacgtcggccgcttctcggtcgtgaaggccgagcagcagggcgtgaaggagctcgacgacgtgtatctcgcggtgcgtctgccgcaggcgcagcggctcgtgtacggcggcgccgagccgcgcgcgaccgcgctcgagatccagctcgcgcgcacggccgatctgccggcggcgcgcgcgcgcatcgagcgctgctgcgcggcggcttcgacggccagccgctcgacgtcgtcgatttcgcgacgctgaacccgttctacgaccagaccaaccggatgttctcggtgatcttcggtttcgtgttcgtgctgatcagcgcgatcgtgctgttcgtgatcagcaacacgatgagcaccgcgatcatcgagcgcacggtcgagatcggcacgctgcgcgcgatgggcatgcggcgcggcggcattcaggcgctgttcgtctgcgagggcgcgctgctcggtgtggccggcgcatcgctcggcgtgctggcggcgctcgcgattgccgcggccgtcaatcacagcgggctggcctggacgccgcccgcgcgcatcgacgcggtcgcgctgacggtgcgcgtgtggggcgagtggcgaaccatcgccgtcacgttcgcggggctcgcatgcgtggccgggctgtccgcgtggctgccgtcgcggcacgcggcgcggctgtcgatcgtcgatgcgctgcggcacgtatgacgccgtgcggatgcggtctttttcgttcatttcactttccgggagagcgcacgtgcgtcgcctgttcgtttcatgctgtctgagtctttcattcctggccggcgccgcgcacgcgcagccggcgcccgatccgcagaaggtgctcgcggcgagcgacgcgatccgcgcgccggcgaaatcgttcgtgctgaccgcgacgctgatcgagtatcggtcgggcaagcaggtggacggcaatacgctgtcgatctattcgaagcccgacgcgccgggcggcgcgttccgcacgctggtgcgcttcgtcgcgccggcgcgcgacacgggcaagctgatgctgaagaacggcaacgacctgtggttctacgatcccgcgaaccaggcgagcgtgcggatctcgcccgaccagcggctgctcgggcaggccgcgaacggcgacgtcgtgacggtcaatctcgcgcacgactacacggccgagctgaagggcgtcgaggacatcgccgacggcgaccggcagacccgccgcgcataccggctcgcgctcaccggccacggcgacgggctgacgtaccgccgcatcgagatctggatcgacgcggcgaacaaccggccgctgaaggcgcgcttttattccgagagcgaccggctgctgaagaccgcgttctaccggcgctacacgatgcagctcggcgtcgagcggccgacggaaaccgtcatcatcgacgggctcgacagcaactgggtcacggtcatgcgtttctccgactacgcgtggcgcgacattcccgatgcatggttgcagcgcgactacctgtcccgcttccaggcgcaatgacggtgcggcgtcgatgccgggtcgccgcgctcgcgttcatgctgctgccggcgctcgcgcgtgcggcgtcggccggcgcggaggcgacgggcggtgcaggcggtgcgggcggcgtggatgcggccgatgccgcggcgctcgatctcgccgaccggtccgccgcggcgccggccgataccgcgaagccgtggaagctcgacgtgcaggacgcgttgcgcgcgagccgctatcgcgacggcgcgcacgccgggcgcaaccagctgtcggtcgaattcgagtacgggcagtggctgacgccgacgttcgccgcgcacttctcgatgcgcttcgaccgcttcgatccgctcgggacctcgcgcacgtcgtcgcgcgacgtgacgctcgtgaaggaggcgtacgcgagctggcgcgcggcgccgacgttcgtcgtcgacgcggggcgcgtcaacgagcggctcggcgcggcgatcggctacaacccgaccgacttctttcgcgcgggcgcggtgagcctcgacgtgccgcccgatccggacagccgccacacgaaccggctcggtacggtcgcgctgcgcgcgcagcaggtgtgggacacgggctcgctcgcggcgctgctgtcgccgcggctcgagcgccgcagcctgccgggcgatccggccgcatcgtccgacctgcagcgcaccaacggcgtcgatcgctggatgctcgtcgcgagccagcggctcgccgcgacgatccagccgcaatggatcatctacggcgaaagcgggcaggcgccgcagttcggccagaacctgagcgtgctgctcggcaactcggtggtcgcctacgtcgaatgggcgggcggctaccggcgctcgctgatcgcgcgcgcgaccggcgcgaccggcgacagcgcgtttcgcacgagctcgtcggtgggcgcgacctggacgctgccgatcgacctgtcgctgagcgccgaattccagagcaacggcggcggcgcggatgcgtcgcaatggcgcgcgctgcagcgcgcgaacccggcggcctggggcagcgcggtgcagacgtcgatcgccgcgcaggagctgcaaacccgtcacggcgtgttcctgatggcgacatggcgcaatatcggtgtgcgccgtctggatctgtcgggtttcgtgcaggccgatctcggcggcggccggcaatactggctcgagctgcggcggcgcttcgagcggttcgacattgcactgcagtggctgcatcagggcggcccgtcgtggagccgcttcggtgcgatgccggagtcggccagcgtgcaggtgctgggcattttctatcgatgacgcaaggagagttcgaatgagcaaacgcgcgcttcaggcggcgaccgccgtgcttgcgctggtcccgtcgatcaccggggtactcggcatgatgggcatccacgatccgttgtacgcgtcgctcggcatcgcgctgccggccgacgcgacgctggacggcaacctgcgcttctacgcgggcgtctggctcgggctcggcctcgcggcgttctcggtgatcccggggatcgagcgccagggacggctgttcgcgacgctgtggacgatgatcttcctcggcggcatcggacggctgatttcgctcgcgacgctcgggctgccgtggccgccgttcgtcggcttcacggtgctcgaagtcgtcggcgcgccgttgttcatcgcgtggcagcggcgcgtggccgcgcacgcaatcttggggaacgcgcatgcatgacatcgacatcgatatcgcgagacgcgccgcgccggtgcgacgcctttgcgcgcgtgcgcgcgcctcctggccggtgccgcgctgctcgcctgcgtcggcctggccgcacccgcggccggcgcgcagacggcggccggcgccgcgctcgacgactacgcggcgacccgctatccgatcatcctcgtgcacggcctgaccggcaccgacgactatttcggcgtggtgccgtactggtacggaatgcaggccgacctgcagcggcatggcgcgacggtctacgttgccgacctgtcggggttccagagcgacctcggcccgaacgggcgcggcgagcaactgctcgcctacgtgaagcaggtgctggcggtcacgggtgcggccaaggtgaacctgatcgggcacagccagggcgggctgacgtcgcgctacgtcgcgtcggtcgcgcccgcgctcgtcgcgtcggtcacgacgatcgcgacgccgcaccgcggctcgcagttcgccgacttcgtgctcgccgcgctgaagctcgacccgacgggcatctcgacgccggtgttcggcgcgctcctgaacctgttcggcgtcttgaccagcgacacgcacaacacgaaccaggatgcgatcgccgcgctcgatgcgctcggcacggcgcgaaccacgcggttcaaccagttgttcccgagccgggcctcggcgccggcgcctgtcgcaccggcgcgcccgccgagacgatcggcggcaacgtgcatctgctgtattcgtggagcggcaccgcataccagccggtgtcgctgctcggcatcgtgacgggcgctgccgacaccagcgtgattccggtcatcgatccggcgaacctgctggacccgtcgacgctcgtgttcctgaccgccggcaacgtgatggcgctggccggtgcggggccgaacgacggcttcacgtcgacctgcagttcgatgttcggcacggtgatctcgacgcgttaccactggaatcacttcgacgcgatcaatcagttgctcggcatccgcggcgcatacgcggaagacccggtcgccgcgctgcgcgtgcatgcgaaccggctgaagctgcagggcgtttgagcgatgacggtccggacgatgctgtctcgcgccgcgctccatggcgccgtcggcacgctcgcggccgcggcggtatggcatgcgctcgaccggccggcggcgtcgacgcaggccgtcgcgctgcctgccgcgcgcaccgtggtgcccgacgcggcggtgccgcagcccgtgcctgcgtccttcgacgccgcgccgcccgcgtcgctggcgggttcgcgcgcgccgcgcctgccgctcgggccggacgggcgtctcgcgaaacgacgggcggtgcgggatttcttcgattacttcctgctcgcgcagcacgacctgacgccggacgagctcgacgcgctggtcgcgcgggaggtcgcggcgcagccgatcggcgcgccggcgcagcgcgaagcgctcgacctgtggccgcgctatcgcgcgtgtctcgccgcgctcgatgcgcagccgggcaccgtgcagcccggcacgcgtatcgatccggatgcgatcgcgggcgagctcgaacgacgggcggcactcgcgagccgctggctcggcgattgagcacaccgttcttcgccgacgcgttccggcagcagcatgacgacctcgaccggatccggattgcgcgcgatccggcattgagcgacgcgcagaagcgtgaacgccttgcggcgctcgaccaggcgctgccgccggacatgcgcgacgcgcacgagcagctcgcgcggcagcgcgaggcggtcgcgacagttgcacggctcgacgcgcgtcgcgcgacacccgatgcgctgcgtgcgcagctcggcgccgacgtctccgcgcgcgtcgtgcggcagcggcaggacgacgatgcgtggcaggcgcgctatcgcgactatgaggccgaacgcgagcggctcgtcgctgcgcccgatgcgcgcgatgcccagctcgcgcaattgcagcgcgattttccggatccggcggacgcattgcgtgctgcgtcgctgggcgcggatcgcgcggacatcaccgctcgccagcgcgcgcggtagccgcccggcgccgacatccccggcaagcgccgtcatggatattccacgttcgccattggagaagtgtgggatatgtcactcagtccgcattatttcgatggaggaatgatttttattttcaggattaactgtattccgttgcattggccgctattcgtaattttcaatgattcaccgggacggcacctttgcaagggcaatatttaaatcgccgataattgattgaccatgcaaatatctcggagtaacgcctgaaactgtcaaattacttcatgtaacaaagccggagtggcgcgcacgacggggctgcgtgatatctttttgtccaattagaccgtaaggaaaacggcaaaaccggaaaaccggttcgtttcaacgctgcatgaagattcggtggccgaggggcaggaatacaacgtacgaggtgcaccgtgatacatcaggccgacaatgtcatcgagttgccgcatgcgcttggtgccaatcaattcctggctgcgctcgacggaattagccgtgcggaattggcgcctcatttgatgctttcgaatctcaagaccggccaggtgctgtgcgatgccggcgagaatctggaggccgtttattttccggtgacggcgggtatttcctccaatacacgacaggcagcaagacgacgctcggcgtgacggaaatcggccgcgaaggcatcgtgtgcgacgacgtcatcggcagcacgacgcagcgccgcgtcgtcgtctatcacggcggattcgcgtatcggctgtatgcgcgccgtttcgccgacgcgtgcgacgcatcgccggcgatcaggcggcaggtcttcgtgcggatgcagctggtgctggcccaggcgtcgcaggtcatgttctgcagccgccatcacgtgatgcggcatcaagtgagccgctggctgctgattgcctacgagcgctcgcgcagcatcgagatcccggtcacgcacggcatgctgggccagatgctcggcgtgcgccgcgagaccatcaccgataccgcgcgacagctccatgagcttggcgtgatccatcagcatcgcggcgccatcgtgctgacggatctcgcccgtctcgcggggcagggctgcgactgccatcgggtcatccgcgacgaaacgtgccgcattctcgcgatcgatgccggtaccgaggccggcgtcgggttgtcgcgacgcgtccggacgacctagttgccggagcatcctgccgcgcggccggcaccggcgtgccgccgcggatggatgagcgccggcgcgtcgcgcgcatggaaggagaggtccgaacgcaagacgcgtcgcgacgcgctggccggcggcatcgagaagaatcagaaaagcagtcaatcgggtatggaaaacatttcgaagctccagagtcagcgcagctcgtttcacgtgtggccatggagtccggcgctcggcatcctgccgatcgtcgtcgtgatcgtcgcgctggccgggttcgtcgccgtcagcctgatcgtgatcatgtcgctgcgcgtgtacgttggcggcgaaagcagctggtcgaaggcgcagaaggacgagatcatcctgctgtcccgctacggacagaccggcgacgaaaaactgttcgacgattacctggcggttgaccgcaccctcacgtttctcggcgttgcccgccgcgcgatgatcagcgtgccgccggaccaccgcgtggcgcgccaggcgctgatcgaggcgggcatcaatcctgtcgatgcggtggcggtggtgtggttctatccgatcctgagcagcttcgcgcgcctgaacgcagcgttgcaatactgggaggacgcggaccggcaactggtcaacctgcgcgcgatcgccaacgcgttgcgcgagtccgtgcaggcgggcgacgtccggcgcacgagccgcctgaaccgcgcgatctgggacttcaattcgcacatcgagccgctgccgaagcgcttctccgacgagctgagcgccgaattccgctcggccgtcatccagctgttcctgtcgtacgtcgtggcctcgctgctgatcctcctgctgtcggtgcgttgggcgagccgcgcgcagcgccagcaggcgtcgatgcagaccgagctggaccgtagccaggcgttcgcggaagcggcgctgcgctcggtggccgacgcgatcgtcacgatcggcctcacgcgcagcattgagaccgtcaatccggcggccgagcagctgctcggcgcgccgtcgcgcctcagcgtcggcaagccgatcaacgacgtgctcgacctgatcgatacgtcgaccggcatgtcgatcaagctgctcgcgtcgctcagcaacagcggcgatcacacgttcacccgcgatctcgacctcatccgcgtgtgcggctcggcggtgtcggtgcgcgcgtcgctgtcgagaatggacaacgccgcgggccgctgcgtcggttacgtgctgatcctgcgcgacatgacacgcgaacaccagttgatcgagaagctgacctggcaggcgtcgcacgacgcgctgaccggcctgatcaatcgcacggcgttcgagcagcgcctgggcgacgcgctgacgcaccgcggcggcgggacgttgatggttctcgacctggacggattcaaggaagtcaatgacgtgtgcgggcacgcggccggcgatgcgctgctgcgcgacgcgaccgcggtgttcgcgcgctgtctcgatgacgacgacgtgttcggccgcctgggcggcgacgaattcggcatcctgttgccggccggccgcaacggcgtgccggacgacggcaaggcggagcgcatccgggcgtgtctcgaggatttcacgttcctgtgggaaggcgagccgttcaagatcagcgtgagcatcggcgtgctggatctcgcctgtcggcccgagagcgtcgagaaggcgatgcaactggccgacatcgcgtgttatatcgcgaaggaccgcggccgcaaccgcgtgcatgtcgccgattcgcgcgacatgaactcgggacgccaggcatatcacatgcagtggagccgccgcgtgaagacggcgctcgaaacgaattcgttccagttgtatgcgcaacggatcgtgccgatccagccggcgcacggcgcgcaggagcgcgcggagatcctgctgcgcatcccggacgccgacggcaagctgatctcgccggtctttctgccggccgccgagcgctacggccacatgacgatgatcgaccgctgggtcgtgcgtaacgtgatccggcggctcgcgcggctcgaacaacgccagtacgtcgaatacaacgtgaacctgtcggcgatgtcgatcaccgacgagcgcttcgtggaattcgcgatcgccgagctgtcggcgtcggggctggacccggcgctgctgtgcttcgaaatcacggagacgagcgcggtccgcaacctggaggtcgcgtcgcgtttcatgtacgagctgcgcgacctcggctgccgcttcgcgctcgacgacttcggcgccggcatgtcgtcgttctcgtatctgcgccagttgccgatcgactacctgaagatcgacggcggcctcgtggcgaccatgacgtccgacagcatcaagcgcggcatcgcgtccgccatcaacgacatcgcacacgtgatgcagtaccgcaccgtcgccgagcacgtcgaggacgcggcgacggccgagatgcttcgcgcgctgggcgtcgactattgccagggctattacttcagccgccccgcgccctggcaggaagggggattccattgaaccaagcgaggaacgaacgcatgagtgctccatttgaactgaccggcgacctgatggacctggcgagctatccggcctggctgcgcgacgtggtcggcgcgaccgacgagctgaaggcgcgtgtccgtgcacatccggtgttcgcggcgatgagtggcgggacgctgcgcgcgtcgcaactgcgcgcgttcttcgtgaccggctgggcggtggtcagccagtttccggagtacatggcgatgaacctggtgaagaccgctgcctatcggtcgcgcggcgaagagaaggcgcggcgctatctgatccgcaatatccgcgtcgagcagaaccacgtcgatcactgggccaactgggctgcggaatcgggcgtgacgaccgacatgctgctggacggcgatgcgccgctggccggattcgcgctgagccactggtgctggaaaagcagcagcgccgacgcgctcgcgccgagcatcgccgcgaccaactacgcgatcgaaggcgtgaccggcgagtggagtgcgttgctgtgcgcatcgccgtatgaacagcagttcgacccggccgtgcggcatcgcgcgatgcgctggctcaagctgcatgccgactacgacgaccggcatccatgggaggcgctcgacatcgtcgcgacgctgctcggccagtcgcccgcggcccgcgacgtgcgggacgtcgagacgtcgatccgcaagagcctgagctatttcctgacgagtctcgattgctgcatgcatgtgtagtcgtttgcgccgcgcgctcgcgggttcgcgcaggccgcacccggccgttgcggccggaaggcgggccggcgtgacgtcgcgattcgccgtgcgggccgtcgtgctggacgattttccatggccacccacgttctcgtcgtagagcccgatccgcgcatgcgtgaccggatccgcgcgctcctgcgcggctgccagatcgccacgtcggcgctcgacgatgcgtcgcggctgctggcgcacgtgacggccacgccgcccaccctgatcgtgatgcgggtcgaacggccggccacgacgttctacatggcgctcggtgcgctgcggcgcgccggtcacgacatgccggtgatcgtgatcagccgcgacgcgcaggtggtcgacaaggtcgttgcgctcgaaatcggcgcggatgactatctggtggagccgttcgacccgatggaactgatcgcacgcgtgcgcagcgcggtgcgccgctacgtgccgaaccgtcccgcgccggtgcgcgagccggtgaaccccgaatcgtacgcatttggcgacatcgaggtgaatttcatcacgcggcgcgccacccgcgcgggacaggacctcgggctgcgtgccagcgaattcgcgctgctcgcactgttcatctcgcagccgatgcgcgtcctgtcgcgtgcggagattctcgcgctcctggggctgagcgtggccgggcgctccgagcgcgggctcgacgtgctgatcttccggctgcgcaacctggtcgagcaggcggtcggcgattatcgctacatccgcaccgtgcgcggaagggctacattttcgtgccgctcggcacgctggcggacgatgtggatgggtcccggcacgcttgagccgtgtgcggccctgcagatcgccattcttttcgaattcgtcacaccacgccttgaaagaatgcttcgctgggtagcccaacgggcgaatgatcggcttgatgcgcttcccgcgtttcaagtgcagattgaccgaccgcatgcgctcttcgcatgaatacatggcctacagtatcgagtacggtataggcgaggtcggctcggggtgtcgggatttccgtgttcaaggcgggtggagccccaggtcagcccctcttcttagaggccagttcaaaacccggcgggggaaccacttacttttccggcaagctgctacttttggttgcctgattcgataaggacatgaagatgaatattcgtgaagcgcaaccaaacgacctcgattcgattagaaagctgctcgaggagaaccaactgccgatcgctgacgttaccgctccgctcctggacgattttctcgtagcggttggcccgggtctcgtgggagtggtaggacttgagcgatttgggagcaatgcgttgctgcggtcgctcgttgttgccggtgacggtcgctctcgcggactaggccaagaactggtcgagaaaatggagaagagagcgagagcgacgggtgtctcatcgctgtggctgctgacaaactctgcgacggagtttttcagggtgcgggatatacgacagttcaccggaatgaggttccgacagtggtcaaaggaagcagagagttcgccgaactttgtccagctagtgccgtttgcatgtgcaagcacctgtgacacatgccgcttttgctgtaataggttagatcaagcaggttgcgccgtgcgcctcaaaatgttccagcagacgagagcgcagctacatttcaagaacgcttcgcgattgtcggctcggcgatcgaaccgaatgcgcagacgccggaagttgtggagccacgagtgagtccgttccactacccagctgaatttgcccggaccgctgccatgaagcgatcgaataacgacgccctgtgtaaaaatcgctgcatcctgcgcggtgtgtgaatcgcgtctcgcatccgggagaccgatttgtttgagtcagaccaccttgacgacgtcttcaacccagaatgatttctgaatgtccctcgtatcgatgacaaaaattaccgaatgggctgccggactgacgctttccattgctccgtggttggcctccaccgcattcgctcaggcgacagacacccaggtacaggaaggcatcattggcggtcaggctgtacaactgatcctgcgtctcgacaatcacggccccagcctgagcggctacgtattcgaacagaacggcggcctgctgttgcccctggaggaaacgccgctggcggatagtccggaggcggctcccgatctgtcgattgacgtaactgatgcgaagggtcagccgttcgcgatgttgatgctgcgttctttccgctggacggatcataagctggccggagactgggtggacctgagaagccgggtccgcaccgcgttccagttcaagcagacggccatgttcgggagcggctatgccgctgtggcctacgatggcgatctgttgcaggtcgggaaaagtggtccgtatctgttccgcgtacacgcacacaaggctcgtggcgaatttggcggcctggtggatcgaatcgatgtctacgatcgcgccagtggcagcaagattcagacactggatcacctgcagctggacttcaactacaccgacacgctggagttcgacgattacaacggagacgggcatacggacttccgtgcctcccggctcgctatcgacggcagcggcaatcgctccacgggcagccggagctacttcctgtttctgaacggccagtttcgcgacttcacgccgctcgacaagctggaagaggatggaacgccctggttcctgccccacggccggatcgacgtccggcaggagtccaacatcgactatcgcaaccgtctcgcgacctggaaccactaccggttcacgtcgcccgggacactgacatttaccggcagcacccaggggccaatgaaccgatgatcaagcaccttaaagccgtcgtggcattgtcgggcctgaccttgtcgggactcggcgcaccggctgcccaagccgcttccctgtttcaagggaccattggaaagcaacccgttacgttgtacctgtccctcgtcaataccgtgaccacggggtctatttctacgaccggcaccgcacccccatccggctcaagcccacgatctcccatacgtcggggacacccacatcgatgagctcgacgccgacgggctgccggccgcccggctcgcactgccgagcgatatcaatccgcccaagtcgtacgatggcacctgggtcagttaccgcaccggacagaaactgcccatccatttgaacctcgtcgcctacagtgcatacggcgccgagccggttccgatacttcaggcggcatccacggatcgctggtatttcgtcattccatcgatcgccacgctcgatcgcgtgatcgaggtgcgggacaagaaaaccggcgatctcgtccaggcgctgaccccgctcatggtgcgttgtgcgattggggcatcgatacggtgaaggtgaaaaggacggacctgcgccggagttgagcgtggcgggggtaacggtcgaaaacggcgcgtgtgggggccgcatttgcgtgggatcctcaaaagcaggcatttcgggaagtgcgtccgtaactcgggtccgggagcaaaggaacaaccaactcacctaagcgggcatgttgcccgtcaggcaagcgatagcgggatttgtcggcggagggcattgcattcccacatgcggagcctgtccgtaagagggccgggcaacgaacgccactcgatcgtgtgcgacccatcagcgacgccctcggcacaactcgcgccatatgctgagcattcggagaggttgcgcagagcactactcacgataaggcagctagggacgtcacattgaaggatcgggacgtttgatcattggcatggcaagcgccgcacttgcgcagttcggcgtgcggtcgagcagccagcgtagccatgcgctttgccggcaggcagcgatgtcctgatcttgggctggagatgcccccgcggctaaaagcacactggcgccgagtatcagcccggaggtgtgcattgtgaatccagtgagtcgttttcacggaattccagctgcgcgtcgccgcgaccgacgcaccggtgacggcgcgcgagcgcgtgcatgaaggcccaccagcccccaccttggtgactggttgttgagcgtggtgaaggactgggaccagcccgtgtcggagggtagcggtaccttgacctggcattgggccgagcgcgaacggtcgtacttgatggtgttgagatcgacgtcaacgaacgagactccttggcgaactcaagccacgatcttgcgattggccgcgcctggcaggacacgcaggcgcttgtcagtgatggcccggtagttccggctggtaatcgtgtccacgtaggtgaattcggccacgcactcatcgcgcgtagcggtcagcacgacgtagccacgccgcgaagtgtcgcaatacttcagcggttccaccaagttcgtcagagtggcactcagcgcggctggcttcacgttggttatggattgctccataccgggcgagctcaccgatggggtggcgaactcaacgccaacctggcggccctgtccatcgagcaggtcgctggcccaggcattgtgcgaatcgccagccagtaccacgaggttcttatccagattgcgcgccatctccagcacggtttcgcgcgcagccgggtagccgtcccacgaatccaggctggcgggaatggagggcgccttcagcacggccagctcctctggcgtcagcgtctgcggcgcggtctgcgccttggccgcaatctccatgtacctgatcaacgacacacctcccacgcccatcattccaaacagcaacggagacggtaactcgaggtggcccatcagcacctgttggcccagcacctgccaggtggcggtggaggcagccatctgcttggccagccagttggtctgagtggttccgagcagttggcgtgccgggttgccgatggcgctggcgaagccggccgcgtcgaacccggcctgggtgacgtagttcgcgtaggagagctgcttgtcgcgagcaatcgcgcgagtgtccaacatgtgcagggccagcaggccgccaaagtcgaagctgcggtagatctgctcggcattggcaccgctgcgaatgggcatccattcgtggtaggcctggatggcagcggccttgcgcgccgcgaagtcgccttccgcaggctggtgattctgcgcgccgtcgcgccaggtatcgttgctgaactcgtggtcgtcccacaccgcaatcatgggcagggcggcgtgtagcgcctgcaggtccgcgtcaccgcggtactgtgcgtagcggcgacgatagtcgtccagtttcacgatctcgtgggcaggttcgaacaggcggccgagctcagccgcctgcggggctacggcactgatgtcttcacgcgagtattcatagatgtagtcgcccaggtgcagaacggcgtccaggtcgttgcgtttggccgcatcggcatagacattgaagaagccggacgggtagttggagcacgagagcactgccaatcgcacctgagagatgcctgccttcggcagcgttcgagtgcggccaaccggagagagctggtcgtaggccctgaagcggtaccaatagctgcgcccggccgacaggcccatggcatcgatcttgaccgtgtggtcgcgcgcagccgaggtgcgcgcctccccgctggcgacgatgttcgtgaagcccgcgtcactggcgacctcccagtgcaggacgatctcctggctggactcggtgctcacgcgtgtccacaggatcactcggtcggccaatgggtcaccgctggccacgccgtgcgcgaacgcgaccttcgggttgccactgcctccgaaagagccgccgtcatccccgccgccgcagccggccagcgccacccgctgatggcaaccgcacccagtgcgacctggcgtacgaagcggcggcgctcaggctgcgggggcatggcctcggccagtgggttgatcattggattcttggtattcgacatgcttgagcctccctcacaaagaagcccgcaagcttgccgatggcgagtgacgcgataattacgatcgcattacttacaaattacaaaatgcttcgcgcattggcgcgttgctgcgctttacgtgaaggctcctgtgagcatgcttcccatagggcgctgcgttgtacggaagccatgaccgaatccgttttccaggtgcaccgccttccttggcgatatacgggagccgttttctcgagcttcgatcgggctgaaaattccagggcaggtcaggtcttgttcggcgttggcgagggcctgcccatggatgttcagacgcggcgcttctttccgagaacaatgtcatacccggatcggggccggctcgctctcgcgccagcgtgccatcagcgtattcgacggcaacgtctcgtcgcgcagcttgcgtgcgacatcgacgccggcgaccggtaacccgtgtggatcgagcaacccgagctggacgagcacgctcgcctggtcccagtagatgtgttcgttgtagagcttgggcccgcggaatgcgacgacgacaaccatcggaatctccacacgcttgccggtcggtgcgacgccgggcagcaaccagtcgatctcccggtcgtgcgtaaacgtcaggatgaattcgtccaccatgcgatcgacgccgaccacgcgcgagatcggcgccatcgccatgtcagccggattgttgtggacgaaatggtgcgtgtagaagcgcttcagttccgtgtacccggtgccgcccgtcatggtcggcacgtgattcacgtacggctcggacaccatcgtccgcatcgtctcctcgggatcgcgcgcggcgaactccagatggaagtgatgatcggcgagtgcacccaggtcgtagtcggggccgagctccttgcgaaacaccgcgaggctgcgcgtatgcgcggacatcgccgccgccttgacaaaggtcgggccgttacggctgaatgcgtggccggcgccctcgtagacgtaaagcttcgcgttcggcttgccgtccagcgccgcgcgtatcgccgtcacggtctcgggcggattgagcggatcgtcggcgccgaaatgcagcgcgagcgggcacgcgatgcgctcggccagttcgagcgactgctcgatgccgacgccgtaatagccgacggcacaatcgacgtcgccctgggccgcggcgagccaggcgagcttgccgccgagacagaagccgagcacgccgacccggccggtcgattcgggcaacgtgcgcgcatgggcaacggtcgcgcggatatcgtcgacggcgccggccacatcgaggcgcgtgtaatagtcgaatgctttggcatggtcggcttcgccgtaaccgagttcgatgttcgagccgaacgggtggaacaggtccggtgcaatgacgacatagccctcggccgcatagagatccgccacttcgcggatctcggcgttcacgccgaatatttcttgcagcaatacgatgaccgggccacggccggcttccggcagtgcgagataggcgtcgaacgccgtgtcgccccgaactattctgatgtgcttcgtcatggatgaggtcccgatggagtaggggaggaatgcgagccgaacggttcgctactgcgctgcgtgccgctcgaaccattcgcgcggcgagcggccctgatccggccccaggatagaaaaaccgccgtcgacaggtacgtcgatgccggtgagccacgatgcatcgtccgagcagagaaacgcgacgatgcgcccgatctcgtcaccgcgaccgacgcggcccaggacgtgcagcggccggccgacgcggtccgcgacatcgaccgacccgcccgcgagccgttccagcgatggcgaccacgtccaggccggcgatacgctgattgcccgcaggtcgcgcggcgccagatccacggcgaggttgcgcgtcagctgcagcaacgctgccttcgacgccggatacagcgcgcgcccggccgcgccgaacttgccgcccacgctgccgaggttgacgatcacgccgcgtcgccgcagatgcggcgcggctttctgcgccaggatcgccgccgacacgagattgacgtcgagcaggcgcgaccattgttcgcgcgtcgacgcgaggcctgcgtcgtcgtagctgcacgcattgttcacgacgatgtcgaggccgccgaagacggtaagggcggtcgcgatcgcgctgtcgagttgtgcgtcgtcggtaacgtcggtgcgtgcgaagcgcgccgatgcgccgatcgaagcggccagcgcgtgtcccgcatcgacatcgagcccggcgatcaacacgccaacgccttcgttcgcgagggcgcgcgcaatgtcggcgccgagcccttgcgtcgcgccggtgacgatcgcgaccttgcccgcgagacgcgcgtgcgtgctggccggactcgtctgcgaggacgattcgggagaaggcgaaatgttcatgcgccctccgtttgcgccgcgcggccgaacaactcggccacactggaaatgcccgcgatcaagcgcatcgactctatcgatgcatcgtgctgtcgacgatccgcgcacgcgcaggcatcagccgcgacggtcacgcgatagccgagatcggcggcatggcggacagtcatttcaacggtcgaatgcgtggcgacgcctgcgacgatcaggtgacgcacgtcgtgcgcggcgaggatccgttccagcggcgtaccgatgaagccgctcgtacaccgatgatggatgacatggtcgagcgcgcgcgccgaatcgggttcgagcgtcgggtaaaactgcgcgccccagctgccgtcgcgcaacgcaccaagctcggccgtgcgcacgaaaatcggcgcattgcgcggcaagtccgcgtaatcctcgcggaaggcgatgcggacatgcgcaatcggcaagccgagcccgcgcgcgccggtgatcagcgcgcgggccacgtcgagcaccgccgcgcggtcgggttgatccgcgtcgaagccgacgcgaatcttgccgcgcggatcgagcacgtcgttctggtaatgcagcgcgatcacggcggtgcgcgcaagcggtatcggcagcgatgcggcgttcacacgaatacctccaggttcgcgagcgcatcggtcgagttgatgagatcgacgcgcttcagatagatcttccagtccgggccgctcgtatcgagcttgtgcgtgacgagcccggcgagcgtgcgctgcccgatccgccattcgttgacgatctgtgtcgagtggaccaccagccggccggccccatcgcggccgtcgacgatcacgttgccgacgacgcgcgcggtgcgcgtcgacggctgctgcgaccagttgcgccggttcgtcacgcgggccgcgcgcacttcgcgcagcgtcgcatcctcccagaagagcgagatatggtcgcgcggattggcttggcccggctcgtgtggcagccagtacatcccgtcgggcgtccacgtgtcgagccaagcgtcgaatgcgcgcgtgtcgagcagccgcgcctcgcgaaacaggaactgtgccgcctgcgcgtgcagcgcggcgtcgaaggcgagggcaggggcgtcgaccacgacggtcgacagatcgaaagccggatcgtgcagcatcaggcgtctccttcgcgcgtgcgcgccgtcgggacggcctcgtcgaccatgaagcgtttccacgcggcgaactggttgcgcatcggcaattcgctggtgccgttgatcgacacgaagccgtcgtccgtcgcgcgatccgtgcccgcgtagcgatgcatgctcacccactcgccgccgcgggtctggttgccttcctggcagcgcgcgtagacttcgacgtcgtcgggcatcacgttcgacgacggcgaattgatcacgttcgcgtaggtcaacgcccggtcgaacacggcatcgggcgcgcctttcaggcgaaacagctggatttcgaccagcgtccggtccaccgcaatcggacgaatcacgcggaactgctgaaacaccgtatgcggggaaccgctgccgtagatcacggtattgtggcggttcatgccgagaatccggcgtgcgcgttcttcgccgtaaacctccgcgagcaccgcgaaatgcgcgctcgacaccgaatcgcgttcggcagccgccgggtcgaaaataccttccatgtagccgtggccgtatgcgtacgcgcgcaattccagtctttcccagaattcgtacggctcgccgttcccgtccatgatgagcagctcgaacggcatcgcgcccatctccgcggcctgcgcgcgggccgacaccaccgacgattcatgggtgaccggcgcatgcatcgtgtcatgcaggttctcgtagaacaccttccagttcgagcgctgcaggacgcggaacactccccgtgacttcgacctcgccgaccggggagcggtcgcacaggttgtcgatcgacgacacgacgccgttcaggaaggtccgcagatccgggccatcgttgctctggctggcgaacacgaagccgcgatagctgtccacgcgcgcgacgcggcgcatcgagaaatccggatgcttcgggtcgaagcaggtgttctgcaggccgttgcgcagcggcgccgacaggtgcgtgccgtcgtgcctgaacgtccatgcatgatatggacaccggaagaacttcccgaccgagccgtcgccgtcgggtacgactttcgccccctgtgcggacaccggttgtagatcacgtggatcgtgccgtcggatgcgcgcaccatcacgacgtcctggtcgccgatgcgcgtcgtgtgatagtcgccggccgtcttgacctggctctcgtggccgacgtagatccacgcgcggccgtagatccgctccatttccagcgcgaagatcgccggatcggtatagaggcgcttgtgcacgctgtcgggccgcaccagcccggccagtgtctcgttggtaacgctcatgggagtacctcgaagggagggtcaaagatccagcacgagatgcgcgccatgcgcgcgcgacacgcatggacagaacgcgccgctcgcgtggtcgtcgtcgctcaggcagatatcgcggtgatcgggggcgccgtcgagcaagcgcaccgcgcacacgccgcaatcgccgcgccggcagtcgtagagcggatcgaggccggcttcgatcatcgcgtcgagaatcgacgtgccgggtggcacgttcagcacgtgccccgaaccggcgagacgcacttcgaccgtggcgtcttccaccgtcgcgaccggcgcggcaaagcgttcgcaatgcagcgcgtcgtcgcgccagccgagatgccgcgcggccgcgagcgtcgcctcgatgagcccggcggggccgcacacgtacagatgcgtaccgttctcgggcgcgccgatcgcgtcggccagcggcaggccgcgcgacggttcgccgtcgtcgaaccagcatgtcgcacccggtagcgcggcgacctcgtcgcgataggccatcgacatcgcgtcgcgcgcggcgtagtgcagcgtgaaccgccgcccgctgctcgtcagttcgcgcgccattgcgagaatcggcgtaatgccgatgccgccggccacgagcaagtgccggcgtgcgtccgcgacgagcggaaaatcgttccgggcggatcgatgtcgaattcgtcgccgggcgcacaggcgtgcatccactgcgaaccgccgcttccggccgcttctcgcagcaccgcgatttcgtaacggtcaatcgaatcggcgctgccgccggcgttcacgagcgaatacgcgcgccgtcgcgaacgagggagagcggcacgtgcacgccgatgtgcgcgccggcggcaaacctggtagcgggccgccatcggcggcgacgagatgcaatcggcggattgcgggcgtcagtgcatcgatgcgctcgacgcggattctgagcagggacatccagaggctccgttgaattcagaggagtccactgtatgcgggcgaatgtgccgagaatatccggcgatcgcagcgcctgtccggcgcgcgcagaatttccgctcaggcggcggactggcgcgcgcgccgcaacgtatccgacggcgattctccgaacgtttcgcggtacagggcggcgaatcggcccagattcgcgaagccgcaacagagcgccacgtcggccacgcgatcggtgtcgcggccttgccgcaatcggtcgcgtgcgtgttcgagacgacgctcgcggaccagctgcatcgggctgccgcgcgaaaagcgttgaaacccgtcgagcagcgtgcgcacgggcacgccggcagccagcgcgatatcggccagcgtgatcggctcgcacgcgtgctcggcgatataggcttccgcgcgcttgaccgtgcgcggcacgagcgccgttccgccggatcgcgcctggcagtgatgcggctggccggcgagcaggagcgagatcacgagccgctcgaattcgagcgcgatgcggcggtcgcgctgcgcgagcgcgacggtctccggcgacgatgtcatgacgcgcaactgcatcagccacggcaagagttcggagcgggaaggtcgagcaccggctcgatctgcagatggtcgtagccggtgtgagacaggatcgcgtgcttgtcgacgcgcacgaagaactgctcgcagtcgcgagagaacgtggcaccgaaatggctggccgggctcacgatgacaccctgcgccggcccgacgatcatgcgccggccgccgacgctcacgtccgcatagccgccgaggctcaggatcgcgagatagtaatcctcgatttcgccggcatcgacgctcatcgcgacgtcgtaaccgatcgtgccgaacccgacactgtcgatccgcacgtagtccatgtacgcggaatagccgccgcgcgagctgcccgggatgagtcgatgcggctgcagcaccgcggcgatccgttcccgcgtgtcgtcgatatcgaccgactcgaaatagcggtatcgacggagctgggtcggctcgatcggcaaggaagcattggacatggcgaatcttctttgcgtatgcgggaaacccggagcgcgatgtcggacgatcgccgcggtgttccgggtcacgtccactgtacacgtttgcagcaaggtcaataaaacggccagtaacggcctctggatacttgcgggaattggacaggtggccgtgtgcagttgcgtttaccggctggatggtgagcggaggtcgaacagcttacgcggcccgaaagcggacatttcaatctagccgctacaacacaaactaccgataattcacgttatgtcaattcgaaaaactgaacaaacctgttgccgggttgtggcggccggacgtgccgcgacgcgcgtggcacgaaccatggtcggcgggcgtgccgacgttacaacttgggatcgcgcttgccggtcatgcattcgtgccgtccgccgcgtgtatagacgtccacgcgcgcaatctgcgacatcgaaccaccggagtacaccgtcaaacggccgatgcccagcggggccaagagccgggacagcatcggtctgcaggcaggcgcgcatgtcgtccggtcattgatcagggtgacctcatcgccgagcaggccttcacgatgccccagcaataaagtgcccgcctcggagtgaaatagaaattgaaacgtgtttccctttgacccatcaaggccgaggcattgccgccacgcccgcgtcaactggaaatcctgggtctcccgcaaagtggaattgatcccgtacacgcgatccgagcccaagatcgtgccgatcgatcccaatttatccccggtcttgaaccggccatcaggattgtttggcagatcgagccctcttctttcccgaaatgaccggattctttgatagccgtcaaatggcgtttcctctcgtttaagaccgagaggatctcgccagccaaatacgttgggcgcgtattggtatgggttgattccaccatcgattcgaatggggtcctggctgacgaagctcccgatcatcggatcgtaatatcggtatcggttgtagtgcaggcccgtttcccagtcctcgtactgcccctggagccgtagtcgctgatcgtcggcagcgtgcatccgggctgaaccgacatgcccccacgccccgtagcgcccttcccagatgattgcactggattgatcgatcagtcgtgtcggcgccccgctgggctcggtttggaagaacacgttgcgcgtcgcagattccgacgccgccgtcgactgatccgaacggttcttcggtgtgtatcgcaacgctgccagtggccgaaacgtaccagggtaataaacccactcgcacgattctccatagccatccgccggagagatgtcgaccgggcccgctccccagccaggatccagctcgtcgacgacattcatcaacggcacgtcgacgttctggtccgggcgcgctatttcacccaccaacgcgtcgccgtcccaaaagtaatcgtgacggtgcgacctgactgtcgatgctgataccgacccggccggcgcgtcaggcttgtcgaggatctgcgtagtcttccggatgcgcctttgaaagacgtcgtacgcgtagcgggtatgaatacgactcgcctggatcgcagggtccgccggcatgcgtaccgccgatgtttcgatcagcagcccgtcgccgtcccagcgcagcagcaaatcctgttgcgcgtcacgcttgcgtatcaggttgccggtacgatcgaacgtataacgacagccatcgtgctcgccctcgcggacccaggcatcgagtggcaatgtcgggtccgacacaccggtgcgatggcccgggttgcttctcgtcgtcaacaggtcgcccgcaggatcgtgcaggaagcgcagcagtttgccgctcgggtcgaggtgcgcggtcagcttgcccatcgggtcgtaatcgaaacgttcgataccgagtcgggagtcgcgcttctcggtcatctcgccgttggcatcgtatgtgtactcggtggcaaagatggcgccggtaccggacaacaatgtttgccgtgccagttgcccctccttcgtgtacaccagctcgcgtcgcaacgcctcgcccaggtattccacgcagatccggccaagcgcgtcccgctcgagcttgacgggcgcggcatcgtcgatctggatcgaggcgacggcgccgaaagcgtcgtagccatagcgtacggtgtgcgtcacggtttcgtgaccggtcacgagccgtgtgcggcgctcgatgcgccgcccgaccgtatcgtaccggtaagcgatgacgaaatcgtcgccttgcctttcttcaatgaggcggcctgcgtcgtcgtagcccagtctgaggcaactgtccggattctgcgccccgacgagcctgccgatgcggtcgtattcgaatttctcgatgcggaaaccgtcggcctgtctggcgtccgcgacctgcttctgcaccacgcgcccgaacctgtcggtcaggtagagaacagccagcccggccgggtcgacactccgtcgcagttcgccgaactcgccatactcgtagcgacgcagttggccccagtagtcgacttcctcgacaatgcggcccatcgcatcgcgcttgagctggtatcgttcgccgcgctcgttgatgacgccaatgagccggccttccgtatcgtactggtattcgacgctggttccgtccagcgatagccgtttggtgattcgccccagcgtcgagtactgaagctgcgccgtagcgccggccggatcgcgatagtgcgtcaggttgccgtcggcatcgtacccgcacagaatctccttcccgctcggctcgattgcgcgcgtcaaattgccattgcgatcgtattcgtaccgactcgtctgtccgagcgcgtcgatcacttcgacgagatgtcctcgcgcatcgtgccgatagaacgttcgatggccgagtgggtccgtcaccgccgccagatgaccgtcgcggtcgtattcgaatctcgaaagttcgctgcatggtccgatctgtgcgacaagctgtccgtacgagtcgtactcgtaacgagaggttgcattcgacggcgtcgtttgtgcaagcaaattgcctcgctcatcccattcgtatcgccattgtcgttcgccgggcaacgtcacgcagaccggatgatggttcgagtcgtactcggttcgaatcgacctgccatccggcagcgtttccatcacgagattgccgcgccgatcgtatgcccacgacgtgatacgtccggcggaatcggtcgcgccactcgtgcgtccctttgcctcgtaccggtaactcgtgataccgccgagcggatccagctcgaatacaggcatgccctgcgcgttcagttgcagtactgtcgtatgtcccaacgaattggtgatacacgtttgcattcgtgtgcggtcgtacacaaatcggtaattgaacaagccgtcgtcgccccatgcatggtcgacgcgccaaacgccgtcgtcgtcggtgcagtaatggtaatgaaacgacatgccccgcgcggtcgtatgcctgacgatccgatgcccgtccgcataatcgaagcgatacgggcatcccattgcatcgaccgcggcacgcaagttgccgtctcgatcatgctcgtaggtaacaagcggatgcgcgtgtccattcgcgtcgaccagcgtcaatgcggtcagcaatccggcatgcgcggcgccgttcgcatcatgacgcgtagcgtcccggatctcgcatgcgatgacgcgcccggttgcgccatcccgtctccattcggcgatacgttcgagtcgtccgccctgatcgcgttcgaagacccatgcatttccgttcgggtcggagatgcgatggatgggcagcgtcggtctcgactcgccgctcggcggataatcgtttgccgccattgcggcggcaacgggaatccgtattcgatgctttcgcgcgtgcgcagcaaagccggtcgccgagcaggtacaacgcatccgcttgctgccagtcgcattcgcgcgaggaccagccttcggtcgcgggcagtgcatcgaacgcagtcgtatgatccggaagataggccaccacgccgatcgcgtcgtcgttcggcaacagctccaaccggatatctgctggcgtctgccaacctgctccaacggcaccgacatgcgtatcgtgacttgaatagtatcgatcccactcgagcggcaagcgtcccgatacgatgaagtcgcgttgctccacgaccacttcacccgtcgacgcgtccaccggctccgcgtgcaacaccttgcagcgcaagaaccccggcttcaaatgcagcttgtctgccagcgtcttcgcccacttcgatccccgaaatgccttgaacaaccccttcgccgccgcggccatgttcatgatcggtggtccgcccaccaacacgggccttcctgccggaatcggcagcatcaccgaactcggcatcgacggataggttcgatcggtatgcgcgctgttatgcggtggcggctccatcccgatcgaccagcaactcaacgcctccagcgccatgtacgacatcggatcgttgttggcgagcaccgtcttgctgcccatgaacgattccccgtcatttgacggttcgaactcggccggcggcggggcaaacgattcgccaagcggaaaatgcaaacccggaacgtgatacgcatgcgttccggccgtggcccgcatcatgccgttcacgaaaatcggcctgccgctgccgccacccgatccgacgttcgagccaagatcgtcgctgatgcgattcttgatcgtgttggctgctttcgccagtttcatcccctcggcgacattggggtcgctggtcagttcattgacctgctggcccgcttcatcggcgaggtgttcgagcttcgccacatcttcagggtgatcttcgatgtattcggtcaccttctcctgcacgatcatcatcgcaatgcagccggccacagcctttgcggcctggatgtactcgcgcagatcgagcatgaacccgacatggggtgcggcaggaacaccggcggcgtacccggcgtgaccagtaccgaatgaacgtccacgccaacaacgggatccagatgcttgacggccagaagtgccacggtttcgcccccgctcagcgaccactgcgcaacgccgcgaccttctcgctcaacgcgctgcgccgtcggtcctgtacaccgagctgcgacaccatccactcgacaaccatcggcagattgctgttcgcccgcatcggctcgtcgatcatcaatcccgcatcgagcgcgttgaacccggcctccagcgcatggtcacgctccctgcccgcgcccagcacaccgcactcatccgccacgcctcgaccgtcatcagcccgtccttcgcggcggtagtcgacgccaccgcacgctcatagcaatacgccgagtgcgcataatccccgtgcgtcagatgcacgctcgcttcgccgaacaaaccattcgcgacaagcttgtgcccggccggatgccctgcttcgaccgcacgcatcccgctgctgacggcactgcgatacgcttcgatcgcacgcgcccgatcgcgccacttcagatatgccgcacctgcgatcaaatgcacgaccacgcactgatcaaaccactcctcgcgctccgcgacgctcagtgctgccgcacgcagttcctcgagccgtgcgggactgccgccttcgatcatctcggtcagcatcacgaagtgccgtcggaactcgccgctcggcccgcgctcgcccgattccgccagcaattcgcgcggcacgctcgccatcgaatattttcccgtacgacacgcactgccgcccgatgccgttgcatcaacacagcaaacgatgcgatttcgatacgcggcacgacaaagcgcacacgctcggcaagctgcggcgcgattgcaatgatcgacagcacatcgtccatccatcgcacccatgccgtgtcatcccgcactttcgccggctccagcacgaacaccatcgccggaaaaacatccggatggtgctgcatcaggctgtcggtaaccgcgaacagatacagcaacggattcttgccgtcgtcatacggcggctgccagttcgcacgcacgccctgcgcatcggcccctctcgccggctgtcgtagaacgcaacgagttcatccgtcaatgcctttgcataacccgattcatcgacgaacgacgcccgcatcgtcctgaccgcgcacgacgtctcgtcctgaacctggaaatacagccgcacgagttccgaatcggtctcgtcggtctgccagatcatcaatctcgcggctttgtctttcgcgaaactcatccagtccgcatgcgcatccatgaacctgcgctccaccggattggtcggctgccagttctgcattcgtgcgggcctccgtcacggattcagtttcaggacggcaccttcgaccgtgtgctccgcagtcgccgacgacgtcaccgtcttgccgttcacgctgtgggtgttcgtaccggtcgatgcgacgttgacgccctggatcgtgatggtgccgtcgctcttcatcacgatgctcgacatcccgcagacgagcgcaagctgatcgcctgcgttgacgagcacctgatgctgcacgttcgtcgtatggttcgcgccgacgttgacggtgtgctcaccgccgaccgtgtgcgtgtgcgcattcgcaatcgtcgaagtgcgcgtgccgatctcttcggtatgcgccgacgcgaccagcgtcttcatgtcctgcgacgtcgtctgatacatctgtccgacgttcagcgtcttggcttcgccgatcgtttcggtcttggcttttgcaaccgtctcggtgtgcgcgccaccgatggtcgcgtcgcgattcgcggcaatcgtcacggtttcgttctgtccgaccgttcgcgtccggttgccgacgaccccatgcgtctcgttcgccccgatctgcgcgacccggttctgcccgatgttcaccgtctcgttctgccccacgctccgttgccggttgttcttcacctgcatcgtttcgtcgttcccgaccgtatgcgtatggttgttcccgacggaaagcgaatgatcgagttccgtctccgcatcgaaattccgttctgcgtgcatccagagctgctcggcgcccttcttgtcctcgaagcggaacgcattcgcatgctcggtcgtcccgcccggtgacgagcgcgacagcaacccgctctgcgtcgcgctcccgggcagcccccatggcggcatttttcgccgttgtaaacccgcccggtcacgatcggctcatccggatcgccgttcaggaaatccacgacgacctcgtcgcccacccgcggaatctgcacgcccccgaacccaccacccgcccaaggactcgacacccgcacccagcacgacgaatcctgattgctttgcccataccgatcccaccggaactggagcttcacgcgcccgtattgatcggtccagatttcctccccggcggcccgaccacggtggccgtctgcggcccgttggtgcgcggccgcggcgtgtcgcgcgacgaccggtaaggcaggctcgacggctgcacgagcatcatcgtttgatgcaccacggcctccgcgccctgatcgctcgcatacgcgttctcctggaagcggtactggcaccgcacgatcaggtattcgcggttctggtcggcgcgcgggcaacgttcgagcgtgaacaggtaaccgggcgcgacaccgcgcacatcggtatcggcgctcgcccgctcatgctcggcctgctgctcctcgagccgaacgcggctgtaatgtgcgcccggcgcatcgtcgcgatagccgcccggccactcgaacgacgcaaaactgtcgtgatcgtgcccacgcggatcgaccttctgcgacgaaagatcggcacgcggcttcgtatagtcgtagtcggtggtctggtgccggccgacgctcacttcctgcgcgggcagccagccgtcgatgcgctcctcgtcggcgatcgcggtgcggtcgcgcgcgatgtacggaatcgtctcgtagccgggcagcgccgtgtgcgacgacatcgcgtcgcccagcatcagcgtatgcgtatcctcggcgtgcctgaaccagaagtagatcccctcgaactccatcagccgcgacacgaacgcggcgtcggtctcgttgtactgcacgcagtaatcgcgcggcacgtaagtctccgccagatggctctcgatcggaaagccgtacgtcgacagtacctcctgcacgatctccggcacggtcttgttctggaagatccggcaatcggagcggcgcgtcgcgagccacaaccagggccgcacgatcagctcgtagcagtagtaccgctcggcgcgccggccggcgagcgacgcgcgcgccacgatgccgttcaggtagcgcgtcgacaggtcctgctgttcgatccggaccgtcacgggcttgccgagcatgtccttcagcgacaggctgtgactgtcggcgagcgcctcgatccggaattcgaacagccggccgagttcgtcgctgccgtcgagcgtatggaacttgaggtcgtcgccgtgcgggctgtcgagtgtgaatacgcgattcaaatcgcctcctcctcgtcgaaccggtatgcgaattcgccgtcggccgcgcccagctcgatcgacgacagcgtgcggccctcgagcgtcgcctgcaggatcgcgcggccgatgcgcggcatcacggtatgcgtgaggatcgcgtcgaccatccggccgccggactcgatcgtccggcagcgctcgacgaccagcgcggtcgccgcgtcggtgcagcgcagccggatgccgtgatgcgcgtcgatccgttgctcgatccgccgcaactgcagggcgacgatccgcgcaagcgtcgcgtcggtgagcgggtagtacggcacgatggttagccggccgagcagcgcggcgggaaacacgtcgagcagcggcgcgcgcagtgcatcggcgagcgtctgcacgtcgggcaggcgctcgggatcgcggcacagctgcatcacgcgatcggcgccgacgttcgacgtcagcaggatcaccgtatgccggaaatcgatgtcgcgccctcgccgtcctccatccagcccttgtcgaacacctggaagaaaatctcgtgcacgtcgcggtgcgccttctcgatctcgtcgagcagcacgacgctgtatgggcgccggcgcacggcctcggtgagcacgccaccctgcccgtaaccgacatagccgggcggcgcgcccttcagcgtcgacacggtatgcgcctcctggaactcgctcatgttgatggtgatcgcgttgtgttcgccgccgtacagcgtatcggccagcgcgagcgcggtttcggtcttgccgacgccggacggcccgcacagcaggaacacgccatgcggcttcttcgggtcgtccagcctggcgcgcgcggtctggatgcgctcggcgatcagttcgaccgcgtgcttctggccgacgacgcgttcgccgagcgtatcggcgagcttcagcacggcctgcgtttcgtcgcgcaccatccggccgagcggaatgccggtccagtcggcgacgacggcggccacggcgtgcgtgtcgacggcgggcagcacgagcggcgcatcgccctgcaggtcggccagcgcctgctgggcggccgacaggcgggtttgagcggcgacgcgcgcgtcggcgtcgagcacgtgcgacgggtcgtcgtcgagcagcagcgcgcgggcatcgacgatcgccgtcaacgcgtcgcgttcggtctgccagcgcgtgtcgagccggtcgagttcggcccgggcagtggcgatgtcgtgatcgatcgcatcgcgccgcgcggtatcgccggtgccgagcgcgcattcgcgtccgatccgctcctgttcgacgcgcaggctgtcgatgcggcggcgcgcatcctcgatcggcgcgggcaccgcgtgctggctgacggcgacgcgcgcgcaggccgtgtcgagcaggctgatcgccttgtccggcaactggcgggcgggaatgtagcggtgcgacagcgtgacggcggcctgcagcgcgtcgtcgagcacgagcacgcggtgatgcgcctcgagcttcccggccaggccgcgcagcatcgtcagcgcggccgcctcttccggttcgtgcacgtgcacgagctggaagcgtcgcgtcagcgccgggtccttctcgatgtactgcttgtactcggaccacgtggtcgcgccgatcgtacgcagcaggccgcgcgcgagcgcgggcttcagcaggttcgcggcgtcgccggtgccggcggccccgcccgcgccgacgagcgtgtggacttcatcgatgaacaggatcgccggccgctcggacgacatcgcctcgtcgatcacgccgcgcagccggctctcgaactcgcccttcacgctcgcgccggcctgcagcagcccgatgtcgagcaggtacagcgcgacgtcgcgcagcgacggcggcacgtcgccggcggcgatccgcagcgcgaagccttccgcaacggccgtcttgccgacgccggcctcgccgaccagcagcgggttgttctgccggcgccgcagcaggatgtcgacgatctggcgaatctcggcgtcgcgcccgatgaccgggtcgatctcgccggcccgcgcacgggcggtcaggtcgacggcgaagcgcgcgagcgccgggccgtccgcggcaccggccgcgccgcgcatcgccgtgccgccgcccggcgtcgcttgcccggccggcggcgcctcgggcgagccttcgacgatcgattcgagcgcgtcggcgagcacgtccggcacgatgcgctcgaattcgcgcgtgatcgccagcagcacgttgcgcaactgcggcgtcttcaggatggcgagcagcagcaccgcgccgcgaatgcgcgtcgcgtcgtacttcagcgtcgcgtatacccacgcacgttcgacggcgtcgtcgatatgcacggacagatccgacaccgagcccgcgccgcgcggcagcttgtcgagcgcggcgacgagcccgcggtcgatcgcggcgtcatcgatcgtgaagtggcgcagcacgcgctgcaggtcgccgtcggggcgttgcagcatctgcttgaaccagtgcgcgagctcgacgtacggattgccgcgcaaccggcagaagccggtcgcctgctcgagcgtctcgtagaggaacggattcagttttccgaacaggttgacgcggccgatatcggacatgacggttcccgtttaggcggtttcgcgatgaagggtgcgccggcgcgccgcacgtcgtagcggacgacgaggtcgcgcgcggggcccggttcgagccgctgcccgagccacgcggtgcggccgatgccctgcggcgcgccgagcgcgatcgccggcactgcgtcggccgccagttcgagctgcacgtcccagtcgaactcgatgccgacgtattcgcgcacccatgacgcgagctgccgggcatgcgggccgcccggcaggaagcggcggtacgcgtcgagcgacagcgggccgagcacgatccggaagcgcgactgcgcatcgcgcaccgcgatgccgagcgcgacggcgcccagccgcaaggtcggccgcgtcgcgcggatcgtgcagcgctgcgaccgctcgatcgcgacccattgcggcacgtgctcgacgatgcgggcctcgacaccgaaatgccggcgcaggatctgcacgagcccttccgggttgcgcgtgtgccggacgagatggccggcatggaaataacgcgcatgcggcgcgagcgtgtcggcgtcggcatgcgcggcgggatcgttgtcgtgcgccgcgcgcccgatcaggctcgcgacatacccgtcgaagcgcgcgcgttccgggcgatcgaggctcaccgtcggctgcgcgtcggcccacgcgcggtagaacagcaggatcagccggtgatgaaacaggtcggcgaacgcggcaaacgtcgggtcgtcgtgctgtgcggcgcgttcgtacgcgtattcggtcaggtgcgtcggcagcggcccgttcgggccgaacagcccgaatccgtgaatggcaatgcgcggcggcacggtgccgtcgtcggacacgccggcgagcatcgacgccgcgaacgcgagcgacggttgctgcccgagccgcaccggctcgtcgcgcggccgcgtggcatggccgagcggcgcgcggccgggcgacagcgcatcgagccagcgcaacgcctggaacaggtcgtaaccgtgcggtgcggcacgcaggcgcgcccaccacgcgtcgcggcgtgcggcttcggtggccgttccggcacgcggagacatgtcgcgcgtcatatcgcgggccgcctgccgacacgcgccggccagtgcgcgagcgtgccgcgctgcgcgctggtcagcacgcattcggcgaacgcgttgatcgacacgtggcgcgcgaagaactgttcgagcaccgcgccgagcaggaacgggctgtcgccggagaacgcatggtcgtcgacggtcacgtcgacctgcacgccacgcccgaacatcaggggccggacgccggcagccggcggaacaccggcgagaacgccacgcgcagcacgccgtcgatctgccggcgcatcgcggcatcggccgggtcggcatgcaggccgagcagttcgcgcagcgcatgcgcgccctcgtcgtcgtcgagatcggtcagcgtgtgacgtgcgagcccgagatggcggatcagccgccacgcagtttgcgcgtcggcgatcggcgggcgcggccgcgacgggccgcggatcgcgacgatgctgtcgaccggggccgacacgcgcagcgtgaacgtgttcgcgtcgccgggcggctgcagcagcacgaggtcgcggttggtgcacagcgtgtcggccgccaggtagcgcatcgtctcatcgtatggcgcgcactggctgtcgacgagcgacacgtaggtctcgctgccgacgtagccggtgcgcgtgccgttcgcgcgcgcctgggcggagacgagccgcggttcgcgccgcaccgtgtagtacgcgccgtggttgccgtcgtcgctggcgaacgacgcgtgaaacggccggaattcacgcgactgcccgtcgtcgcgctgctcgctcgcgaggcgctgcaccgcatagacctcgtagtcgagcggccggctgcgatcgacgacgacatggtgttcgcgcgctcccggctgcaactgaatgcgatcggcgcggcgcgcgaacaggttcacggccggcgtgcagttcagcgcgaggtggcgcgcgctgacggccgcctcgagcgccgcgtcgtggcggtcgaacagcacggtcagttcgaactcgtcgccggtcgcgcgagcgagcgcggcacgcagcccgccgatgctgaagaacaggaagcgcgccggaaacgcgaaatactcgcgcaggagccggtagccgtggaagctgcggccgtcgtcgggcaggatcgcctgcgcgggatcgaaaccctcgtggacgatcgcgtcggcatcgagcgtatgcagccagcgcggcggctgcgccggatcgtggcacacgacgccgagcgcatgggcggcgatcagttcgagcaggtgcagcgcgtcgcgctcggggcccgcgagatggaacgtcagccggtcgagcggcagttgcgacagcctggcgccgccgcgcgccttcagccggatgcgcagcgcaccgcgcacgtcctgtcgtgcggcgacgacgccgcgcggcagccacgacggtgcgccggtgacgctcgcatcggtcagttcgagcggccacagcgtcaggtcgtgcgcggtacggaattcgcacgcggtctgctcggacgcggccggccgtgcacgcagcgccgtgccggccggcagccgccagccttgcgcgaggctgccttcgttcagcatcggcgcgaaccgcacgatcgccatcgacggcagcggcgcgacataaccgggatacacggcatcgagcagcgcctgcgtgaagcgcggaaactcggcgtccatcttcaactgcacgcgcgcggtgaggaagctgaagccctcgagcagccgctcgacgtacgggtcgggcggccccgattcattgagccgcagccgcgcggcgaccttcgggaactgctgcgcgaattcgccgccgagctcgcgcaggtacgcgagttcacggttgtagtagtcgagcagtcgcgtatccatcgcgtcaggctcccgccacggattgcagcgacatcgcgcccgtctcgagatcgaggtcggagcgcagcacgaattcgagcggatgcgggatcgaccacaacgtgccgcgaatctcgaacagcagcacgttgtggcgccgttcgccggcgcggccgcccggcgcatcggtcacgctgcggacatcgatgctgtcgggcgcgatgcgcggctcgaagcggacgatcgcgtcgcggatcgacgcctcgaccgacatccgctcgacgcccgacatcggcttgccgacgagcggccgcatcccgtagttgagcaccgacgcctgcgcgtgcgcgaacgccggccagtcgacgaaaccgtcctcggcgttgcgcgtgttgagcagccacgcgagatcgcgcagcacggccgcacgcaggcgttcggtgccgatccactgcgcgccgggcgcttcgctcgcgcgctgcggcgtgtcgtcggtgagccggtcgagcagcgcgggctgaagccggtcgcgcaggttgccctcccggccgtcgcgggttcgcgggtcgtccatggtcgtctccgcgccgtcacatctcggtgttttccttgatgttccagccgacggtcacctccgcgcccttgccgccgttgtcgttctgctgccagtactgcttcttcaccttcgcggcctggaagccgtaatgcatcatcagccggtcggcgacgtcgcccggatcgatccccgcgacctgcgcggacgtgacgagcacctcctgtagcgtcacgcgcatgaactcgacctgcgtgccgcccgtcttgcacgcggagatctcgaccgacgacaaatgcttgccgttcgcgcagttcttgatgatcgcgggtgcccccttgtccatgtacgcggcgacgaccagatcgttgaagctcgccttgcccgcgttgccgccgctaccgctcgccatcgcgcccggctggctcgcgccccacgtgaacgactggatgtcggtccagcccttgtgctgcgcgtccgccgattcgccggtcacgccgtccaccttcataaacattgccacgcccataaccgtctccgtttcagtgcgatgtcaggatgaatgccgcgttgaagtccgatcgttgcatgcgccgccgctcattcgttggccgccttcgcggtcggcaggcgcgagatgagccgcagcgacacggtgagcccttccagctggtaatgcggccgcaggaagaatttcgacgtgtagtagccggggttgtcctcgacctcgtcgacgacgacctgcgcggccgcgagcggcttgcgcgccttggtttcctgcgacgaattgacggggtcgccgtcgacgtaattcatgatccagtcgttcagccagcgctccatgtcgtcgcgttcgcggaacgagccgatcttgtcgcgcacgatgcacttcaggtaatgcgcgaagcggcagcacgcgaacaggtacggcaggcggccggacaggcgcgcgttcgcggtcgcgtcgggatcgtggtactcggccggctgatacagcgactgcgcgccgatgaacgccgcgaaatccgagttcttccggtgcacgaacggcatgaagccgttcttcgcgagttcggcctcgcggcggtcgctgatcgcgatctcggtcgggcatttctggtcgacgccgccgtcgtcggtcgggaacgtgtggctcggcagcccttcgaccgccccgcccgattcgacgccgcggatcgacgaacaccagccgtactgcttgaacgagcggttgatgttcgcggccatcgcgtacgccgagttcgcccacgtgtagcggtcgtggttcgcggcgtcggtgtcttcctcgaagtcgaattcgtcgaccgggttggtgcgcgcgccgtacggcagccgggcgagaaagcgcggcatcgcgagcccgatgtagcgcgaatcctccgattgccgcaggctgcgccacgccgcatattcggtgttctggaagatcttcgtcaggtcgcgcgggttcgacagctcctgccacgaatccatctgcatcagctccggcgacgcgccggcgatgaacggcgcgtgcgcggccgccgcgatcttcgacagctcgccgagcatctcgacgtcgggcgggctgtggttgaaatggaaatcgccgaccaggcagccgaacggctcgccgccgaactgaccgtattcctcctcgtagatcttgcggaacagcgggctctggtcccacgcgacgcccttgtagcgcttcagcgtccgcgcgacttcgttgcgcgacgccggcagcgccttgatcttcagcagctcgtcggtctcggtgtgcgtgacgaggtaatgcagcccgcgccacgcgccttcgagcgtctggaactcgttgtgatgcaggatctggttgatctgctcggacagcttgcggtcgatctccgcgatgatctgcttcacgctgccgtacgcgtcggtcgtcatgccgaccgtatgttcgagcgcctgctgcgcaagcgtgcgcaccgcgcgctcgaccgattcgcgcgcctcggccgtcttcggcttgaactccttctgcagcagcgccgcgaattcgtcgtgcgcgacggcgggtcgcgcggcatcgcgcgcgtcgacgcgggactggacaggatcattcatcgcgggcctccggttgggtcgcgtcgccgctctgcgcgctcgcgtgcggttcgcgcacgagcgtcttcagcaggtcggggtcgttgatcgcgcgttcgatcagttgctcggcaccgtgcttgccgtccatgtacgacagcaggttcgacagctcggtgcgcgcctccagcagccggcgcagcgcgtcgacgttgcgtgcgatcgcggccggcgagaaatcgtcgatctgctcgaacgtcatgtcgacgttgagcatcccttcgcccgtcagcgtgttcggcacctggaacgcgacgcgcggcgcgaccgatttcatccgctcgtcgaagttgtcgacgtcgatctcgagaaacttgcgctccggcaggtccggcagcggctcgacacgcttgcccgccaggtccgaaatcacgcccatcacgaacggcagctgcaccttgcgttcggcgccgtaggtctcgacgtcgtactcgatctgcacgcgcggcgcccgattgcgcgcgatgaacttctgtccgctgcccgccgccttggttctgtccgtcatcgtccactccttcacatcgatcaggttgcgcagtccgtcgttgccgcccgcatggcggtttctttcgttcggttcattcggttcattcgcttcgctcgccgctcagcaggtccagcttcgcgaggctctccggcgcgagatcgcggatgatttcgtagaagtcgagcgcgagcagccgctgcgcgcgccgcagcagcagcggcgccgggtggctcggttcgtgctgttcgaaatagcggcacatcttgtcgagaccgacgcgcacgtcgtcgcggctcgtgatgtcggcttcgcgccacgcgtgggcgttcggcatcggcgtcgacgtcgacgcagcgggtgccgagaccgcctgcgacgcgtcgccgggaacggcctgctgcgtgtcgggcgacaccggttgcggctcgggtagcggcacctcgcgtacgatccgccgcagcgccctctccgcatcgccttcgtcgggtgcccattcacggcccagcttgtcggtcacgcacacgcggatcgcatccagcgcgtgcagtgccgcgcgcgccgcgtcgagcggcgtcgtgccgtcgcccgacgcggccgacagcgcggccagcaggctttcgcggctgccggctacggggctgccggtatcgtcgcggccgtcgagcagccgttcggcgtcgcgcacgctcggcccgctttcgaacagcggctggcggcgcgccgcgcgcgcgtcgtgtgcgccggccacgtcggcgagcgcgttcatccgcggtgtcgggtccggttcgccgtccgcgtcgagccgcggatgcagggtgtcccagcggcgctcgagcaggttcgcgacgagcgcgagcgcgtccgcataaccggggatgccgtgctgctcgatccagcttcgcgcgagacaggcgatcacgcgcaggtccttcgtgcgcgcggacagcgccagcgcgagccgctcgaccgcgcgccagtcgggcgcctcggccgggatcacggtgtcgccgtattgctgctcggcgcgcggcgtcgcacgctcctgcaactgcaggaactcggcgtcgtattcgaggttcgcgccgcacggcgcatcgggcgcgacatcggcgagcaacgggccgatcaggcccgcgcgcggcgtcgccgggatgccgggcggcaccgcggaaaatgcggcggcggccagcgccgcctggctgacgtcattcgaatgcatagtcgatgttgaccggtttgctgccgaaatcgatcgccacggtgcggtgcaacggcggcagcgagccgttgcggatttcgatcacgtagacacccggcgtcagcgataccgaacgcagcggcgggctcgcaccgcgccgcgcgccgttcacgtagacgtcgccccatggccgcacgttgaaacgcacctgcacggtttcctgcgccttcggcgcacgcgcctgttgctcggcaggcagcgcgttcacggcggcgacggccgtctggctgtccggcggtttcggtgccggggatggcgtcgtcaccggcggaacggcggcttccgacggcggcacgttgacgacgcgctccgacgcgtcgaggctgccggcgggcgcgatggcggggctggcgccggccggcggcggggccgggttcgtcacggtggtcgcgacctgcggcgcgggcgcggcggcctcgacggccggcgtgctggcaggctcggcggcgacgcgtggcggcggaacctgtgcggacgatccggccggcaggctggacggcggcacgacgatcggcgtcggcccctgctgggccagtgtggcagccggcgtgctcgcgggcggtgacgtgccgggctgcggctggctcgcgacgggcgcaggctcgtcggccacgcgggcgggacgcgacagataggtcgcggcgagcccgacggcgatcagcgcgacgaccgcgccaccggcgtagacaggcagccggcgcttgcgcgatccggcgggggcgtggctgtgctgggcgccgggcggcacggaagcgccgcctgacgacgctgacgacgatgcagcgggatacggcgcggtcgtactggcggcaccggcgccggcaccggcaccagcgccttcagccgcgaacgcgtccgctttcgcggaacccgccgcaccacgcgcgccgatgtccgtatcgggtcttgcggatcgcgcgccggtttcgtcgcgcggatcggtgcgagcagcggccggttctttcgcgcgttcgacgtttccattcggcgcatcggattcaaccggttccgcggccggccgggacgcatgcgatgcggaagctgcgaacgctcccgcagcgaccgtggcggctgcgccgtgcgtggccgctttcaacgttggagacacatcatcggtttccggcttgccgtctgacacaccgggcgatgcggatgccgtgtccgtgggcgtcgacacggggcctgcacccgcctgcgtcggcggtgcagcgccacccgaagcggccccacccgagccgatcgaagtcgcggcggcagccgacgcggtcccggcctcgacagaagccgccccttgtctccccgcccctgcccgcatcgcccacgggcggcacggcgggcgcgccatacccgctgcccgtccggtcgaagtcccgcaacccgagttccgccgcgaatgccgcgaccgattccggccggtccggaatccgcaactgcagcgcatgatcgacggccgcgagaaaagccgggctgtacacctcgccggccggcagttcacgcgacgcgagcggccggtacgtgtccttgatgctgcgcacgacggccgcgggcggcaactcgccggtgatcatcgcgtgcatcaccgcgccgagcgcatagagatccgtccacggcccctggctgaacgcgggatcgtcggtgtattgctcgatcggcgcgtagccgggcttgatcatcatcgcgccgtcgtcgaccagatcgccgatccgtttgcgcgccgcgccgaagtcgagcaggatcgcgctgccgttcgggcggatcagcacgttgtcgagcgcgacgtcgcgatgaaagcactgcgcgcgatgcagcgtgtcgagcgcgccgagcagcgcgccgacgatgttgcgcagctgcgtctcgctgatccgcatcccgccgtcgagcagctgcttgagcgtgcgccctcgtagaacggcatcaccatgtacgcggtgccgtggctttcccagaagtgcaggaccttgacgagccccggatggtcgaattgcgcgagcaggcgcgcttcgttgaggaacgcgccgcgccccgcgtcgaatgcctgcgcgaaccgctcggagcgcagcgacaccgtatagtcgccgccgcgcgtggccagcatcgacggcatgtactccttgatcgcgaccgcgcgccgcaacgtgcggtcgaacgcgcgatagacgatcccgaagccgccgatgcccagcacctcgtcgagctgcaattcgccgaggcgatggccgagcggcagcggccgcaccgtgaattcggatgcgtcgccgcgtgtcgctgtgtcgtgctcgttgtctctcgatccagcgtccttcatctccaccacctctcgaaaccgcgtcctttccgctcgccgcgcccggccgctaaccgccgccgaacagcgtcaggaacagcgcgttgtcgggcgtgcccgtgtgcgcgtgcgtgcgcagcggcgatccgtccgcgcggttggtccaccagaagctggtgccgccgtgcggatcgaagtaaccggacagccccggccacgcggccggcgccggccgctccggcagcggcgccggcgtgccgtcgacgatgtccgcgtggctgtcgacgcccggcgcgagccgcacgcgttcgagcgtccgctcgagatcgcccggcgcgcgggcatggcggatcgcgtcgagcagcgcctgtccgacctgccagtagaacgcgtcggcggcgtccggcagcccgctccagtaatcggccgcacgcatcggcagcgtgacgatcaccgggtagtagcgccccacgcggtcgcagctcggcgcgaggcagcccggctgcacgcacgacgcgccggcgcccgccgggatcaggaaattccagaccggcgcgaccgtgtaatggcgctcgatctcgtccgcgccgcgctggcgcatcgcggccatcctgctggagccagcgctcccaccacagcgcgagcgcatgcggcagccggctgttcacgaagtcgccggcgccgggaatcttccgtaccaggccggcgcatcgccgtcggtacgcgtgaacggcggtgtcgggctcatggcttcggagggcatgtaaaggactccatctggggcagcctgaacgggttgcggacactgcccgcattcacttgcagcacgaccggtttgccgtcgaccgtgaagcgcgcaatcatctggtcggagccgcgcccggccgatacggccgcgcggtcgaacagccggtgcagcgcccacggcccgtcggtcgagaagccgtcggtcgcgccggcctgccccgacacctgcagccgcacctggctgctgccgcgcgggcccggccagtccaccgcgctctgcacgagcgggccgtgcgcgtagcggacgatctgcccgtcgacgtcgagcaccatctccgtgatcgacgggtccatttcgagcggctggatctgcaccttcagctgcgcggtgcgcgcaccgccgccgaaataggcgtcgcggatcaccgccgccttctcgaacgacgccagcatcgcggcggccgacggatcggcgtccgcattgcggttcgcgaagcgccacgggtgcgacgtcgtatcgacgatcgactgcaggttcttctggaagaagtcgtccatcaggccgccgggtgcgaacatctgcgcgaaatccgccggcgcgacgtcacgcgacgatccgcgcgcgaacggatagcgcccgcgatcgcctgccggcagaagtcgccgacgttcgcgccggcccgcgtcgcgacgctgcgctgctcgacggtcgccacgctgccgttcgcgacgttcgacaggtcgtcgagcacgtcgcggaacggcgtgggcaggcggccggcctgcgcgcgcagcttcgccggcgcgtcggacggcggcggctgcgcgccgctcctcaatgcgtcgtcggtggccgtcaggtaggtgtacagcgcgtcgatcgacttcagcacgtcgttgaacgcctgggcctggtcgccgctgcccggcgcgaacgcgcgcaacccggcgaagtggctatcgacgatctgctcggcgctcgcgggcgctgctgcggacgtgttcgcatcgcttcccttgctcgcgaagatctgcgacagcgagctgcgcgcctcgtcgaccttgtcctgcgcgcgcgtggcgagattgcgcgccccgccgcccggtgcatcgccgagtgccgtgtcgcgcgcgagcgcgaccatcagccgcgtgagcggcgaatcggcggacgacagcgcgcgtgccacctggatgctctgcgcgagcgtcgcggtgcgctgcagcttgatgtcggcgagatagtcgtcccagatcttcaggtagtcgttcaggtacagctggcggatatcgcgggcccacgcggccgcgtcgttcggcccgggaatctcggaaagcccgaggttcagcacccacacttcctcgcgcccgtaggcctcgacctcgccggccaggcgcggcgcgaacacgttgcgatagccgttgcgcgtatagaggcccggcacgccttccgacagcggcttgccgccctggcggcggaacaccagcgacgcgtcggggccgaccgcgcgcgcgacgctgaagtcgaacgcggcggtggccggccgcagcgtcattgtgagctgccggtacagccgctgcgagaacggcacctgccgcagccggtcgcgcacgtcggccacgagccgctcgttcatcggatacggcgacaccgcgacgcggccgccgaacagcgcggcgagatgcgcacgcagcgcggtgcgttcggccggcgagaaatcgggcggcagcgcgcgttccatttcgagatcgacgacggcctgcacgaacgcgggatcgtagtgcgcgctgtcgtacagcatcaggtacgccttcagcgccgcatacgcgaattcggtctcgtcgggccgtgcgtcgcgcagcgcggcctccatccggctcgcggcgatcggcagcagcacgtcctcgagcgcgcgccggtacacggcgtcgacggcctcgtcgatcttctcgccctggaacagcccccaccggtacgcgagcggcggatgctgcaggtcgacgccaccggtattcgcgaggccgccgagcgcgtcgagcacgggcagcaggcgggcgacgtcggccgcatcggagaatttcgcgccggcaatctgcgcatcgacggccggcacgcgcgcgccgatctggtcgagatacgcgcgattgttcgaatagctgcgcagccaggcgaccagcacggccacgcacaccagcgcgagcagcacgtagccggcgatctgcagcacgcgccgtttctgatgccagcgcaggtcgctgccggcgagcgacgcttcgcggaagatgtgctcctgcagcagcgacttcaggaagaagctgcggccggtcgagccgacctgcgcgaccggcggcacgccctcgatcttcaggaagcgcttgatgccgctcatcacgcgatcgaacgcggtgccctcctgcgtgccgctcgtcaggtagacgccgcgcagcatcggcatcggttcgtagctcgacacggaaaacacctcggcgacgaactggccgagcatgtcctgcaggtcggcgatctgctgcggcagcaggtacgtcatctcgcgctggcgcgcgtcggtctgcgcggcgagcagttcgggcagcccgtcgttcagccgctggtgcagcagccggtattcgcggtcgaatgccgcacgcaggtcgaaacccggcgcctcgctctgcgcgagcgggaacgtgaaaccccacacctgcgcgcattccgcgcggccgtagttgccgaaatactcggcgaagcctgcgagcaggtcggccttcgtcacgagcaggtacacgggaaagcggatgccgagctgcgcgcgcagttcgagcagccgcttgcgcagcaccatcgcgtgctgcgtgcgctcggcctccgacgcgccgagcaggtcggccacgctgatcgtcagcatcgcgccgttcagcggctggcgcgtacggtacttcttcagcaggtcgacgaagcctttccactcggcctcgtcgagcgcacggttgccttcgtgcgtcgtatagcggccggccgtgtcgatcagcaccgcgtcgttcgtgaaccaccagtcgcaatgccgcgtgccgcccacgccgcgaatcgccgcgcggccgaactgctcggcgagcggaaaactgagcccggaattcacgagcgcggtggtcttgcccgagcccggcgcgccgatgaacacgtaccacggcaactggtacagatactgtcgcgacatccggtcgaaccagcgcggcaggcccttgcgcacggtgtcggcctgcccgaagcggaccttcttcagcagcgtcgcggcttcgtcgaagcggctgcgcaactcgtcgagctgcgctttcgccggatcgtcggcggtggccggcccgggcgccgcttcgcgcagctggttcagcagttgcgcgttgagccggccggcgcgccagctgcgccacgcgacgcgcgcgccccacgcgacgaacagcaccgcgatcgtcagcccgcgcgcccagccgctttcgagcgggcggacctcggcgaacgcgaacagcgggcccgcgagccacacgaagcatgcgagcacgacgagaccggcgaaggtccagatttcccgcgacggcaacggccggacgaaacgcgcgacagcctggttcatgtcagttggctccctgcgttgcgctcgcgccgacggcggcactgccgggcgccggcagcagcgtgatctcgacgcgccggttcagcgcgcgattcgcgggcgaatcgttcggcgcgaccgggtcgagcgtgccgcgcccttccgccgcgagccgttccggatggtcgagccgcgcggcgatcatgccgcgcacggcttccgcgcgttcgcgcgacaggtcccagttcgacgcgaagcgcgccgtatgcacgggcgtgtcgtccgtataaccggtcacgcgcacgttgccgggcaccttgtccagcgcgtcggccacacgggcgagcaccggcacgtagcggtcgatcaccgacgtcgaacccgacttgaacaacccgtcgccgcgcagcacgatcacgctgcgatcggcggcgtcgcgcaccgacacgagtccggccgcgatctccggttccaggaacttcgcgatgcgcggggccggtaccgggcgcggcggcgcctgcgcgggctgcagcttcggcacgtgcagcgcgtcgatcgacgcgaacagccggtccgaatgcccggcgagcgcgatccgcagcccgacgaacacgccgaagccgatcagcagcgcgagcgccacgcacacccacagcggcacgacgaaccggcgcgcgacatcgcgcgtgacgacgtcgcgccagtgcggcgacagcgccggctcgaattcgccgcgcaccgagcggatcgtgagcgcgagctggtggcgcagcgcgtcgagctgcgcatggccgttgtcgagcacgcgataacggccctcgaagccgagcgcgagacagaaatacagcagctcgagcaggtcgagatgctggcgcggctgctgcgacaggcgttcgagcaggtggaagaatttctcgccgccccaggtctcgttgtggaacgacacgagcaggctgtgcgatgaccacacgctgccgccccacggcgtcagggcggccgcctcgtcgagcgccgtgcacaggcagtagcgcgcgccgatgatcgcttccgacggcacgccggcctcctgcgcgcgcgcctcgaactgccggatctcgacgacgagatgctcgcgcagccacgcgggattcgggtgatggacggtcgaacggatctgcggcacgaggttgagcaacggattggcggccgcgacgagcgggttcgtgccgctcgcggcccagcgcccggggcgcggctgcgtcgcggtcgggccggccgcgcccgccgcggccggatgcatgccgcccggattcggcggcacgaatccgcctgcgccgggagagatcgaatcggaggaggaattcatcgcgtcgcccgccctcacccgcgtatcgcccagaactccatcgagagtccagggaattcgccggcgaaatgaaaagcgagaccaccggagcgcgccagctgcttccacaggtcgctgcccttgtcgatctcgaagtacgtatggcccgcgtgatacgggatctgccgcggcgcgaccggcaactggcgcatcgtgatgcccggcagttgcagctgcacgagatcgcggatccgctcgaccggcccgagcttggcctgtgcgggaaaacgcgcgcgcaggctgtcggccggtacgtccgcgcgcaccgcgagcacgaagccggccgtgtcgcgcagcaccgggtcggccagcgtcgcgacgcggatgccgttgcccgcatcgcgcagctcgatctggatcgcgttttgctcgagcaccgtcgacagcgaccgccgcagttcggtcatcagttccgcgaagctcgtgcgcaggtcgtcgtgcacgtagacggcgagcgactgcgggcgccggccggccgccgtgaacgtgctcaggtcgcacgcgagcttcagccagtcgcagaacagcgcctccggatgcgtcgacacgtgctgctgcgcatgccaggtcagcgcgagatagcggttcacgagctgcagcagcaggaagtccgcgacttccgacacgccgccgcgcccgggctccgacagccgttccgcgagcgcttcgctgcgttgcgtgagcagcccgtgcagctcgcgcgcgtaggccagcagcacggcgtcgtgctgcgcgacgaggcgcggcgggatgtagccgtcgtcgacgagcagccgcgcatcggtgcgccgctcgacgatccgggcgacgccgagcgcgtgccagtcgccggtcagctcggcttcgagcatcagccgcacgttcaggcgccccgtctgcagcagtgcgggaccgagcgcgaccgcgttcgcgtcggccacttcgtattcgcgcacgacgtagcgcgcgacatcggcgccgccgttcgtgccgttcgtaccgttcgcgccgctcgcggcatggcctcccctgcaccgaacgacacctcctcgccgccgccgcgccacagcggcagcgcgagcacgacgagctggtccttcgcgtcggccggcacgtcgagcggttcgggaagatcgtccggatgggacaggtcgaacggcgtgccgtcgcgcatcacgcccgacgcggtgcgcagcgcgaccttgccgagcgccagttgctcgcggtcgagctccagcgtgtcgaagccccagaagaagccttgcagcggaaggcagcgcagcgcgacatagcgttcccagtgccgttcgagctgctggaaatgctgcggccgcaggaacatcccctcggtccacaccacccgctggcggagcgccgcgaccggtgtcgcggacatcgtcggttcggtcatgggcgccccttcgcatcgttcagtgcgaggccgccgttgcgcaccgcgatcgacagcttcagctcgcccggcgacgtctgccagaacttgtagagattgagctgcttcgcgcgcggcagcgcaccgtcagccgccagcggttcttttcgagcatccggtattcggcgaccacgccgaccgcgccggcctcgacgttgccgcgatagtgcagcgtgcgcgactcgcccggccgcaggatcacgcgatcggtgccgagcaggtccgtgccgagcacgttctccggcttgtcctgcagcgagaagaaatccgcgctgtcgaacgacgatgccgcgcggagctggaacaccctcagcacgatcggcgcaggcttgcggttcgggtcagggttgacgtcgggtgcaacatcgaccgtgatcgcatacggcaccgccgcggcgtgctccgtcgcgccgcatcccggcaacagcatcacgcatccccatacgatgaaactgctcgaccgccattgcatattccaccctcgccacccaatagccgttcgccggttttcgaccgcgaaaccgtttgatccgattgaaaaagggacaattaattgatcggtaattgtgtaatccgtatatccatccacctcaatccgtatcggcaaattgttcttgtaaaaagccgggtcatatcattcatggattttgaaagtcgatttggcgagatggtggtcaattgagaattggggttgatgaattaatggcaaaaatcaatccgaccggttcgccgtcgcggcccggttctgtggcgtggacacctgtcggatgggctcgggcgcaagccggccggccaccgggcaacgaacgctcgcggcgctgacggtgtgccaggctattcgtttcgcacgaacggacggcccgtttttcgtgcattgacgtgcgctgaccaaacaactgacgaatccgaaaaacacagcgaactataggccgtttttctggattcacaagcactgaaattcgtagtcgattctgcattcaggtggaaatggaatggcgaaatgaaacaaaacgtaacaggcgattcggcgccgatgattggcactagaatccaacagcgcttgtgtggcaccttccaattacgccaattcttaatttcaataatgaaaggtcgttcatcgctcgttcttttcctcggcgcattgttgctgggggccggcgggtgcagtacgtccccgacccagtcggctgcacgcgcgacggtcgacagcgcgcgcgccgcgtacgacagcggcgactacgggcgcacgatcgcgctgctgagccacgcgaaggaaatcgacggcgccgacaccgacacgcaggttgccgcgcacaagctcctcgcgttcagctattgcgtgacgaaccgcatcacgccgtgccgcgccgagttctcgaaaattctcgaactcaacccgcgcttcgacttgtcccctgcggagaagggacatccgatctggggcctgcgttcgaattcgcgcgccgcaggcatgcgtcgtcgtcctgaacgaaccggcctgcgcgcgagcacttcaccgagcgacgtatgacatgcaactgatcgtgatcgaacatgccggcgagccggtcgaaaacgactcctacgacgccgtcgtgtttcatccgccgggcggcaccatcggccgggccagcgacaaccatctcgtgttgcgcgacgacacgcggcagatttcgcggctgcaggcgctgctgcaggtgggcgacgacgcctgcctgctgaagaacctgagcagcgtctcgacgatcgaggtgaaccgcgagccggtcggttatgcgcaggagcgcgcgctcaacaccggcgacatcatccgcatcgggccgtacgtgctgcgcgccgaacgtgacgacggcgtcgacggcgtcgatggcggccatgcaccggtcatcgacatggagaccgattccggcacgcgtgtcgatatgcaggcgcaagcgcaggcccgggcggcagcggcgcccgcgcaaccgtcgtcatcgcgtgtcgatacgaaaggcgccagcaaccggctgtgggggctcctccaggatcgtctcgcgccgcgcggcaaggcggcggacgccgctacgcggccaggcggccccgcacgtgcgggcgcggcgcagcaggccgcaccgcccgcgccttcgcagcgcgacctgcaccagctgtcgactgatccgctcgacctgttcgcgcagtcgtcgggcgacctcggcgcagcgggcacggcggcgcacgccgatcgcggcaacgcggatcgcgatgcgtcgtccgcgacgcaggcggatcacgcgcccgagtggacgcagcacgtgcgcgtgcaaccggccgccgcgcacaccgatacgcggccggccgacgaaccggcgccgcatgcggcgcgcgcgccgaccccgacgaactgctgagcgcgttcttcgaaggcgcggggctcgacaccgcggccgaatcgcatcagtggtcggccgagcagctgtacatcgcgggcgagttgctggcgctgttcgcgaacggcacggtcgagctgctgtcgtcgcgcagcatcctgaagcgcgaggtgaaggcgcacatgacgatgctgctcgatcgcgagaacaatccgctgaagctgctgcccgacggcggcgccgtgctgcggcagatgttcgggctgccgctgccgggcttcatgtcgccgcagagcgcggtcagcgacgcgttccaggatctgcacgcgcaccagatcggcatggtcgccggcatgcgcgcggcgttgatggacctgctgacgcgcttttcaccgcagcgcctgcgcgagcgcgacgacgcgatgcgctggtacgagaagcgcgtgcccgtgctgtacaaggcgaggatgtgggatcgctacgcggcgacccatcgcgacacggtgttcgcgatcgaggacgatttcgcgtcggtgttcggcaaggcgtttctggcggcgtacgacgcggaagtggaaagctatcgcggcagcggccggcattgagcgtcgaaccgcgcgcccgccatcggtcgcgggcgatgggtgccggcggaggcgtcaggtggccgcaccacacgacgcgaccttgtttcgccccgtttccttcgcgacgtacaacgcctcgtcggctgccttgatcaccgactcgacctccccttcctgcccgggcgcccagcttgccacgccgatgctcgcggtgacgcgcccgaattcgctttccgcatgttcgatcgccagtccgtcgatggctgcacgaatcctttcggcgatctccgtcgcacccgtcgccggcgtatcgggcaggatcacgacgaactcctcgccgccatagcgggccgcggtgtccgccgggcgccggatgttgtcgccgatgcaccgtgcgaccgccgccagcgcgtcgtcgccggcctggtggccatacgtgtcgttgtaggccttgaagcggtcgacgtcgacgaacagcagcgaaaacaccgatcgggcacggcgcgcgcggcgccattcgagatccagcacctcccgaacgagcggcgattgttgagcccggtgaggccgtcggtgcgcgcgagcatgaccagctcggattcggcgcgcatcctgcgccgcagctgcgagcccagcatgaaggacagcacgatgaacgccacgccgaaggtggcgaccagcgcgccgatcgtgatggcccggtgccgccacgcggcgtagatgtcctgctccgcctcggcgaccatgatgatcagcggcaggtgcggcagcgtcttgaagtagtacaggcggcgcacgttgtcgatcgtcgaggtttcgacgaacgagccttccggtgccgtcatgaagtggcgaaacgtcggcgccttgctgatgtcgcgaccgatggtgcgcacgtcgaacggctggcgcatgaacatgatgccgttcgtgccgatcagcgaaatcgcgccgtgcgagccgagcgcgaggccggcgaacagcgtgtggaaatactcgagattgaccgcgatcatcacgatgccggcgaacgagccgtccgggttcgacacgcggcgcgtcagcgcaacgctgagcgagccgctgcgcaggcgggacgcatagggatcgctgatgtaaagcccgacgtccggattgtcgcggtgcaccgtaaagtacttgcggtcgccgaaattgccgtggcgcggcacgtcgttcgccgaatccaggatgatgttgccggcggaatccagcacgagcatcgagccgagaaaattcgccgtcatcgcgtgatcgaacaggatgccgcgtcgcagcgccggcggggcggccatgacgtccggccgccggaggccctggatcaccgcctcgagcgacaggccgtacagctcgatgttgcgttcgatgtcgcgctcggcgacgagcgccagatttcgcgacgtctctcgcgcgcgatcgagcgcatcgtgacggctctggaacaactgcaacacgcagaggcccatcagcgcgcacgctatcaaggtccccgccagcacaacgtagtacggcgctgccgaccgcggatgcatccgtgtcctctcagattggcccggcgccgacgcaccggtcgttatggtttgttctgaataacctataccaaaaagtgcgacttccgggtacgaggtgcagtcctgacttgccgggttgcgtacgacatgacctgagcggtgtcgcgcggatcgtgttccgctcgggccggcaccggtgccggcgttcgttcaccgaggggcgtcgcgtggtgtggcgtgtggtgctgccgatgacggaatcgaaacaatccgtccgcagtggtacgcgtattgaaattgccgtcaggttgccatgcgaatgcacggccggcgggaaagcgggcgggagaccgggcgtgccgttgcgcggtgcgcaacgcgcgtgccgcccggctcgcgccgatcgcgcgcgccgcgccggcggcgccgcgcacgcgatcggtaggcggtcagacggtcgtcagacggccatcaccgtcaccgacttcgtgacgaggtacggttcgagcgcttccggcccgccttccgagccgtagcccgagtccttcacgccgccgaacggcatttccggccacggcgtcgcgggctggttgatccacagcatcccgacttcgaggcgctgcgtgagcaggtgcacgttcgcgaacgaacgcgtgaacgcgtagccggcgagcccgaacggcagacggttcgcttccgcgatcgcgtcctcgagcttgtcgaaaccgcggatcgccgcgaccgggccgaacggctcgttgttgaacacgtccgcttcgagcggcacgtccgcgatcacggtcggcgcgaagaagttgccttccgagccgatccgctcgccgccggtttcgatgcgcgcgccgaccttgcgcgcgttgtcgacgacggatgccatcgcggtgagccggcgcgggttcgcgagcgcaccgagcgtcgtgccttcctcgaggccgttgccgaccttcagcccttcggcatgcttgaccagcgcgcgcgtgaattcgtcgcggatgctgttgtgcacgagaaagcgcgtcggcgaaatgcagacctgccccgcgttgcggaacttcgcgccgccggcggccttcaccgcgagcgcgacgtcggcatcctcggcgacgatcaccggcgcgtgaccgccgagctccatcgtcgcgcgcttcatgtgcaggccggccaacgaggcgagctgcttgccgaccggcgtcgaacccgtgaacgtgaccttgcggatcaccgggtgcggaatcaggtacgacgagatttccgccggatcgccgtacacgaggccgatcacgccggacggcacgcccgcgtcgacgaacgcgcgcagcagcgcggccggcgacgccggggtttcttccggcgccttcacgaggaacgagcagccggttgccagcgcggcgctcagcttgcgcacgacctggttgaccgggaaattccacggcgtgaacgcggcgaccgggccgaccggctccttcacgacggtctgctgcgcgccgaggttgcgcggcggcacgatccggccgtacacgcggcggccttcgtccgcgaaccattcgatgatgtccgccgccgacagcacttcgacgcgcgcctcggtgagcggcttgccctgctcctgcgtcatcagctgcgcgatcgcgtcggcacgttcgcgcaccagcgcggccgccttgcgcatcgtcgccgcgcgctcgtgcgcgggcaccttgcgccaggcctcgaagccgcgttgcgcggcggcgagcgcacggtcgagatcggcgatgcccgcgtgggccaccttgccgatcggcttgccggtcgccgggttcacgacgtcgatcgtcttgccgctcgcggcatcgacccattcgccgtcgatcagcagttgcgtatccgtataagtcacgttagccatccagacacccctacattgcgtcgataaacgcgcgctgccgcgaacggccgcgcgccggttgacagaaaagccaggccgccggggcaggcacgcacccggcggcgtcgacgacaggcacgcccgcccgccatcgttccgcatggcgccgcgctcagcgcgcggccgccgtcgccttgcggagtttcgcgacgtccgccgcctgcacggccggcgcgccgttgttccagccggcgcgcatgaaggtcagcacgtcggcgatctgccggtcgttcaactggttcgcgaacgccggcatcggataagcggacggcacgccatcgatcacgagcgtctcgctgccgttcagcgtcacgttgatcagcgacgcggcatcgccttcgaggacgttcgggttgccggcgagcggcgcgagcagcggcgcgtagccgcgcccgtccgcgccgtggcaatgcaggcagtaagcgttatacaccttcgcgcccggatcggctgccggccggcccagcgcgacctgcgtcgccttcggatcgtagcggtacggcggcgcgcccgtgccgcctgccgccggcagcgatttcaggtaacgggagatggccgccagatcgtcgtccgtgagggcctgcgtgctgtggttgatcacgctgaccatcgaaccgaacgcggtcgcatggcggttcgcgccggtcttcaggaactgcgcgacctcggcctcgttccagcggccgagccccgtgttgggctcgccggtcaggttcgatgcgaaccagttgtcgatcggcgcacccgacaggaacgccgcgccgccttcgtcgagcgccttctcctggaagccgacgccgcgcggcgtgtggcacgacccgcagtgcccgagcccctgcacgagatacgcgccgcggttccacatcgcgtccttggccggcttgtccgcgtaaggcgtcgtgtcgaggaacaccatgttccacaacgcgagcggccagcgcatgttgagcggccacgggatgtcggacggccggttcgcctgcttcaccggttcgacgtcgtgcatgaagtacgcgtacagcgccttcacgtcctcgtccttcagcttcgcgtacgacggatacggcatcgccggatacaggttgtggccgtccttcgcgacgcccttgcgcagcgcgccggcgaactcggcttccgtgtagccgccgatacccgtttccggatcgggcgtgatgttggtcgtgtagatcgcgcccatcggcgtgaccatcttcaggccgccggcgaacggcgtgccgcgcggcgcggtgtggcacgcaacgcagtcgcccgctttcgcgaggtacgcgccgcgcgcgacgagcgcgctgtcggccggtgccgtctgcgcggcctgcgcggccgggcctgccagcacggcggacagcgcgagcagcgatgcacggaacgtattcagggtgaggtttcgcatgatcgtcgcctcccctcaagccgtcttcagctggtcgccgaccggcagcttgcgcagccgcttgccggtcgccgcgaagatcgcgttcgacaatgccgcggccgttgcggccgtgcccggttcgccgatcccgcccggcgcttcgccgcttttcaccagatgcacctcgatcggcggtgtctcgttgatccgcagcatccggtaatcggtgaaattgctctgcacgacacggccgtcctcgatcgtgatctcgccatacagcgcgcccgtgatcccgaagatgatgccgccctgcacttgtgcctcgatcgtgttcgggttgacggacatgccgcaatcgaccgcgcacacgacgcgcttgacctgcacctcgccgttatccaccgcgacgtcgatgacgatcgagaagaagctgccgaacgcgtgcatcacggatacgccgcgcccttgcccggtcggcagcgacgggccccagccggccgccttcgtcgcgacgtcgagcacgttgagcgcgcgcggcgtcttgccgagcagcgcgcggcggtattgcacgggtcggtcttggtctgcgcggccagttcgtcgatgaagctctcgacgacgaacgtgctgcgcgtcggcccgacgccgcgccagaacgcggtcggtacatggcgcggctcctggcgcacgtagtcgatcagctggttcggcaggtcgtacggcaggtcggtggccacctcgaccgcgtcgggatcgacgccgtgctggaacgcgggcggcgcgaagcgcgcgaggatcgacgagccgacgatccggtgctgccacgcgatcggcttgccgttcgcgtcgaggccggccgagatccggtcgtagtagtacgggcggtacatgtcgtgctggatgtcttcctcgcgcgtccagatcaccttcaccggcgcgttgacctgcttcgcgatcttcaccgcctggccgatcatgtccgtctcgaggcgccggccgaagccgccgccgagcaggtggttgtgcacgacgatcttctccggcggaaagctcgtgagcttctgcacggtgtcgaccgcccgcgtcggcacctgggtgccgacccagatctcgcagccgtcggcgcgcacgtgcaccgtgcagttcacgggctccatcgtcgcgtgcgcgaggagcggctgctcgtacacggcgtcgatgcgcgttttcgcatccgcgaaacccttgccgacgtcgccgtccttgcgtgcgaccgcacccttgccgttcgccgcggcctgcgcgagatcggcgacgatgtccttcgtcgataccttcgcgccggcgccttcgttccacttcacgaccagcgccgatgcgccgcgcttcgcggcccaggtgtgatcgccgacgaccgcgaccgcgttgtccgcgcgcacgacctggcgtacgcccgggatcttcttcgtggccgtatcgtcgatgctcgcgaccgtgccgccgaacaccgggctgttcacgatcaccgcgtacagcatgccgggcagccgcacgtcgagcccgaactgcgcggtgccgtcgaccttctccggcgaatcgagccgcttcgcgggcgtgccgatcagcttgaaatccgccggcttcttcagcgcgacgtccttcggcaccggcagcttcgcggcggcgtcggcgagctggccgtacgacgtgcgccggccgctcggcggatgctgcacttcgccgttcaccgcacggcaggatgccggatcgacgctccattgcttcgcggcggccgcgaccagcagcgtgcgcgcggtcgcgcccgcgcggcgcagcggctcccatgcgtagcgtatcgacgtcgagccgccggtgagctggccgccgagcagcggatcgagaaaaagcttctcgttcggcggcgcatggtcgagcgtcacgctcgacagcggcacttcgagttcctctgcgatcagcatcggcagcgccgtgtagacgccctgccccatctcgactttcggcatcaccagcgtgaccttgccggcgcggtcgatctgcacgaacgcgttcggtgcgaacacgcctgcgcgcgcggtttcatcgccgtcgccaccgatcaccgaacggcgcgcatcgtcgcctgccgccggcaggctgaaaccgagcagcaggccaccgcccgccgccgcgcccagcgacatgccgagcttgaggaacgaacggcgcgatacgcccgcgccggcggcttgtccagcggccttgcctgcttcgatcagtcctcgcgacatgtcatgcctccttcgcggcttgcttcacggccgcgcgaatccggttgtacgtgccgcagcggcagatgttgccggccattgccgcgtcgatgtcggcatcgctcgggttcgggttcgatgcgatcagcgcggtggcggccatcacctgccccgactggcagtagccgcactggacgacgtcgagctcgcgccacgcctgctggaccttgtggccggccggcgtcgcgccgacggcttcgatcgtcgtgatcttgcggcccgcgacggccgcgaccggcagcacgcacgagcgcgcggcgacgccgtcgagatgcacggtgcacgcgccgcattgcgcgatcccgcagccgaatttcgtgccggtgaggccgacgacgtcgcgcagcacccagagcaagggcatgtcgtcgggggcgtcgaccgtgcgggtttcgccgttgatgttgagggtgaccattcagcctccggggccggtgtattgggaaacgacgcgcatcgcgcgccgcgcgggttttcgatttcgtcgctgtcttcgccgttgccgggcgagacggctgccgcgcggcccggggcggagcgggccgcggcgtgggtgctgcttcgttactcggccacgtcgatgccggacagcaccttgatgaccgccggcgccgcgaaccagtcggccgatttcacgcggaattcgccgaaatacgggctcgcgaggtgtgcgtcgaacgcggcctggtcgtcgtagatctcgtacaggtgcaggttgggcgaaccgtcctgttcgcggaacaggtcgtagcgccggttgcccggctcggcgcgcgtcttcgcgaccatgctgcgcagctcggcttcggcggcctccgcgtgttcgggtttcaggtacagggacgcaatcacgtgaagcgccatcttgtcactccttttgaatcgaaatcgagcatgccacaagccggcgtcgcgcgacgccagcgtgcaatcgtcatggtttgccgtgccgcggtatcaggccagttcgtccgggcccacgcgcacgacgaccttgccgaagttcttgccggccagcaggccgatcagcgcttccggcgcgtcggccaggtcggggacgacgtcctcgagcgtcttcaccttgccctgcgcgacccattcgctcatctctttcaggaacggtgcgtaaccggtcgcgtagtggtcgaggatgatgaaaccctgcatccggatgcgcttgcgcaggatcgtgcccatcagtgccggcacgcgatcacggccggtcgacaccgcggtgtcgtcgtatgccgcgtcgttgtagtgcgcgatgattccgcataccggcacgcgcgcgtgatcgttgagcagcggccacaccgcgtcgaacacggccccgccgacgttctcgaaatagacgtcgatgccgttcgggcatgcgtccttcagcttcgcggcgaatgccgggtcgcggtgatcgacgcacgcgtcgaaaccgagcgtatcggtcacgtatgcgcacttgtcggcgccgcccgcggcaccgatcacgcggcagcccttcagcttggcgatctggccgaccaccgcgccgaccgcgccgctcgccgccgcgacgaccacggtttcgccggccttcggctcgccgattttcagcagccccgtgtaggcggtgaagcccggcatgccgagcacgccgagtgcatacgacggatgcgcgacgtcgcggccgagcggaatcaggtcgcggccgtcggacagcgcatagtcctgccacccggcgcccgcgaccacgaggtcgccttcgcggaacgcgggcaggttcgacgagacgacctggctgacggtgccgccgaccatcggctggccgagttgagccggcggcgcataggacggcgcatcgctcatccggccgcgcatgtacgggtcgagcgacaaccagaccgtgcgcagcagcacctgaccggcaccgggcgtcggcacggcaccggattcggtgcggaagttgcccggcgtcggtgcgccgaccgggcgcgaattcaggacgatctggcggtttgcggtcttgctttgcggcatgtgagcctccgtcaacaggaatggacgtgcttcgtgggcacgatcggatcaggggtggaccagcggagacgcccgcatgcggcaacgtcggcggtggggccgtcgcggctgcgtgcgggcgcttgaaacaatggggaacagcgtaacgcggcgtggcacgttcgtcatacttgcttgagtagaccagtcgtctagattcagggcaaaaacaaggcgcgccgatgcgcgcccgggttacgactgtgcgccgccatgctcggccggtggcaggttcagcatccgccgcgtttcgaccatcgccctttcgagcggcttgcggtcgcggtgaatcttttccagcagcgtcgcacccagccacatctcgtagaggatcgcggccgtgtgcgacggatcggcgatcccgctcagcgagccgtcggccagtccggcctcgatgccgcctgcgagccgctcgatgatctggctcgtgccctgccgcagcaccgcgcgcatcgtttccgacagatccgacacttccgcgccgagcttcaccgcgaggcacttgccttgcggatcgtccgcgcattgcgtgtgcagccagttgcgccagtacgtcatcaagcgctcggcgccggtgccggcctgatgcttgagcaggttgtcgagatgcgcgtgatagctgtcgaaatacgcttcgagcagcgcttcgccgaatgcctctttcgagccgaagtaatggtagaacgagcccttcgggatgcccgccgcagcgagaatctcgttcaggccgaccgccgaaaaccccttgtggagcatgatcggcttggcgatattcaggatgtgctggcggacttcggcgcctgaagatgcattcatggtggcgtatgttagcaacgattagaccggtcgtctagcggcgtcgatccggcatgttgagcggcactttacccgatccccgccgggcacccaaacgttgtgccggccttcctttccctgctccgcgttgccgcgcgcggcgtcacacgcacgacccggtttcgtcgcgggcgattcatcgagcgtccgcataactcgtggaatttgggcctcgacacgcgctccctggctgtccaaccacgcgcgaagctgttgcaaaccgatatctcgatcacgttagcgacagagcatattccgaatatcctgatccatgatgttcaaactcatttctctaccggaataatccagtcgtcagaccacgattttgttgttcccatggactgattttgtccaccggagccggcgtggccgtcgcggtgggtgggcgatcgggggtgtagccgtctcgtttgcctgcttgccggcggttggcgtgcatcgccattggctgatgcacgctcgcggccgcgccgtcagcgcggcgcttcgtcagcacgctttctcgtgcgtgcccgtcgctcgtcccgttgcgcggccggtgccgccttcgcgccacgcagcgcgcgcggcgcacgagcaccgtcatctcgcgccgcagcgcatcgagttccttgccgcgcgccgcatcggccgcctgcgcagcgtcgagctgcccctgaagcacgccgcatcgatgcagcgcgtcgcccagttgcgcctgcagcgcggcaacatctttccgctgctgcgcatcgcgctgctccgtgcgcgatgtcacggcatcgagctcctttgcagtcgcgcggcggcgagccgctctcgatcgatctcctggagcgcccgcttctccgacgcacgcaagcgttcctcggcccggccggcgtcgtcgcgtaaccggtcgagctgggtggtgaaatccgcgcgggcctgcgcgagtgcacggtcgccttccgcgttgtcggctgtcaggcgctcgatgtccgcttgcagcgcttgccgcgatgcttcgtcggccgccctcgcctgctccagttcctgaatgcgcacctgcgcggccagcagcgcggccgtgcgttgctccagcgcggtttcggtgcgggccagctcagcctgcagcgccgcgacttccgccttcgccgccgtccgctcggcttcgacttccacgcgcaatgcgtcgagcgcggcggccgcgtcggcgctcgaccgattccatagtgccgcgacgagttcgccggcggccgcctgcagatcggccggcaggtcgggatgctcgatgcggacgcggctcttttcccgtagctcggcccagaactcgccgagcacggccgtcggcgtgctcatgctgcccttgcgaacgagctggtacagacggttcgcggtgggcgtgatgccgaagcggaagaacagcagcgcgcaggcttcgcgatacagctcgcgggttttcgggaagtcggccttgaggcgctcgatttcggcggtcaggcgggattcgtcggcggcgagatcggacatggcaggtttcggtggcaatttcgtcaataatataacgtaaaccgttaaaaatacaattatgccgatttatggatttgacattatttctataatgtcgagatcgtggaatatcggtatgtccccgccggtatgcggcgcgcggccgtcggccagtacggtgctcgcccggtggcgtcaagcgcgctgcttcagcagccctgccagaagggtcagtgcttccgtcagatcgtcgaacgacgggccgccgaggcaaagtcggattccgctcgcccgatcttccgggttcaccatcatggattccggaggggtcaacttgatatgcatcgctgcagcgacggatgcgacacgattggcagcatcgcgctccatcggcagccaggcgttgtaggcgccgggatgcgagaccagttcgctcgcgccgagcagagagatggccagattggatcgacgccgcgcctcatggtgcagatcccgctggatcgaggagatgacgtcggtggccagccattcctcaaccactgcgcaagagagcggcgacggcgccattggcaggtcccgcagcgcgtcctccgctgcgtcgttgagtccggccggcagcgcgagcacgccgatctgcaaaccggggccaagcgatttggacagtccgttcacatgaaaggcgatctcgggcgccaatgccgcaagcggtggcgaagcctgctctgccgacgcatagacgccgtcctcgatgatccacgcgcccacccggcggcatatatccacgatggcctgccttcgttccgtgcccatcgtcgcagtggtcgggttgtgcagcgtcggcgtgagatagaccgccttgctgccggtcgatgcggtgccgtcgagtgcgtccgccagtgcccccggcaccatcccttgcgcgtcggtctcgacgccttgcatccgatatccgttgcgccgagccagcgcgatcgcgcccggataggtaatccgctcggtcagaagcagcccttgcgagccgcaggcaagatcgaacgccaacgatagcgcctggcgggcgccgctcgttagcaccagatgagacggttccaccatcaggcccagcgtttcgagccagcgagccagcacacgtcggtgctccatatgcccagcgggcggggcatagagattgaggtggtccgcatcgatcttgcgtgcgatccccgtcaatgttcgcgccagcaagcgagcgttgagcatggctggcggcacattggacgaaaggtcgatctgtcgatcctgatgcgcctggcgaatcgccacgaaggttccccggcccttgatgctgcgcgtcaggccgcgccgttcaagcgcggcataggctttcgtcaccgtaccaaggccaatccccagtttcaacgcgagatcgcgatgagcgggcaggcggtcgcctcccgtcagccgccctcgacgatgtcgtcggccagggcgaggaccaaccgctcggcggtattcgcctcgatgtcggcaagccgtggtgaccagggagattgcaggagcatgttcgccgcctagatattagtgtcacgtgacactatttatataaacaacaagcgtaacatgtgcgatgtgattggatgaagtcatgcatttctggaggcgcctgatcgccacgacgggcgcgtggagagtcaaatgttcagccatgtaactgttggggcgcgtgatcttgggcgggcaggccgtttctatgacgctgtactcgctccgctcggactgaagcgtcgcgtcgtcacgtccgatggcgggcctccggcgctttgctgggtaaccggtcaaacgccgctgccgcgcttctatgtctacattccttacgatggagagccggcgaccatcggcaacggcagcatggtcgcctttctggccccgtcgcaagaagccgtgaacacggcctacgcgaagggtcttgagcacggcgggacggacgacggtgcacccgggttacgccccgctacggtgacggctacttcggcgcgtatctgcgcgaccctgacgggaacaagatccatatcgttcatcgcggagacctccagccataacgctggagacgccccgcatctctggagaaactcgaatgatcgccagtcagatcgcactcgcctacggcacctatctcatcgccaccgccagccccgggccgagcaacatggcgatcatgggaacagcgatgcgtgacggccgcctgcctgccctcgttctggcggcaggcgtcatcacgggctcactcttctgggcgatcctggcggcgaccggtgtttccgccgtgctggcggcctatgccgaggcgcttttcgtcatcaagatggtgggtggtgtctacctgctctacctggcgttccgcacggggaggtcggcgctgaaaccgggctccgacttcgcgaagatggaaccgggacgctcgacacctcgctatcggcggctctaccgccagggcattctcatgcatatcggaaacccgaaggcggttctggcctggatggcaatcatgtcacttgggcttcggagcatgcctccggcggtaccttgccggcgatcatcggtggttgcgcgttcctcgccgtcatcgtgtttggtggttatgcggtcctcttctcgaccgctcggatgatcgccctgtataccgcccccggcgctggattgaaggcacgctatccgcggtgttcgccgttgcgggagtccggctgcttgcctggcaacgttgatatcccggcttgtcggcgccctcacgaactgatctgaattgaaagagcgatgtcatgacctttgcgatccatatgatcgatgtcttcggcgccgggccgtcttcgggcaatccgctggcggtcgttatcggtgccgatgccctggcaacggatgacatgcagcggttgacgcggtggttcaacctgtccgagaccgcttttctcttgccacccacgcatcctgaggctgactaccgggtcaggatcttcacgctggacagggagatgccttttgccgggcacccgacgctcggcagttgtcatgcgtggctctcgacgggccgcgtgccgaagagcgaagcggaaatcgtccaggaatgcggcgccgggctggttccgatccgacgcaatcacgagcggctttccttcgccgccccgccgctgatccgctccggtgcgccaacacaggatgaattggatcaggctcggcgactgctggggatcgaatcgggcgatgtcctcgatgccgcctggatcgataacggccccggatggctgggcatcaggctggtgtcggcggagacggtgcttgccctcaatccgctccgcagttggcccggccggatcgatgtcggcgttattggccctcatgcaacaggcggcaacgcggccttcgaggttcgcgccttcttcagcgaccatctgggcgctatcgtcgaagatccagttactggaagcctcaatgcttcaatggcgcagtggctgttcgcgacaggtgtggttgaggacgactatgtcgccgcccaggggacacgcctcggccgccatggccgcattcatttgacccgcgacgaggctggccaaatctgggtcggcggcaagactcgcacgcacgtcgaaggccggcttcacggcctttgaaaaggcaaacgagaaagctgcaacctgatgttcgggcgaactggcgcacataacgcctgtccgggtcgccccatacgctgaacagcttgctcgcaagactgcttgccggcgtgacgcgacagcaccggatcaacctgagcactgttctgacgctcgaaaacacgcaaggagttcagcatgtctgcccccgcagaacccgattgctccatccgtaaccaccgatcgcatcacactgcccgcctcggcggcagacaccttaagaatgctggtgcgctacaagtcctgggcgaatggactgacgttcaagagcgtgatggacctgccggctggcgaagcccttcggcagagaccgacgcggttcggaaacatggtgcataccttgaatcatgtctacgtggtcgacgacattttcagacatcatctgcaaggaaagaagcacacctacacctcgcgcaacaccgaccacacgcctgccgtttccgatctttggaaagcggttcaggaaatggaccgctggtacatcaatcttgtcgacacctggtcggacgcggatctcgcgaaagccgttcatttcgagtttgttggcggaggagaaggcgtcatgacccgcgagcaaatcgtgctgcatgtcgtcaatcacgccacctatcaccgcggatttgtcggcgacatgatgtatcaggtgcctttcgcgccaccgtcaaacgatcttcccgtattcatcagggatcactatcgcgatgcccggtgagcgcctgttcggccgacccggcgcacgccggcaacttgtctcgcatctgtgtgggccgcggagaccgccggatgcgcatcgctgactggtcgcgtcgcgaccgtcgcctgtcattgatctgccaccgtcgcccggtagcgttcgggtctgacccacgctttcgacagacgaatccgccatgcagcgcacgtcgcgcgccacgccccacgtttatgcggccacgtcccgtgccctcgccgccagccttgcgatcaacctgctgctgctcgtcgtcgagacggtcgcggcatggtccgcgcattcgtcggggttgctcgcggacgtcgcgcacgcggcgatcgatctcgcagccgatgcgctgatcctcgttgcatgccggctcgacgcgcgcctgccgccggaacggcgcccgacctgcgagccgcttgcgctcgcgggcctcggcgcattgctcgtggcgaccggcgcgcagatgatctggcacgcgacgaaccggttcgctgcaccgcccgtcgtagagccgggcatgacgacgctcgcgctcgtcgccgtcacgctcgccggcaaggccgcgctgtcgcactggatgctgcgcaaggcgcgcgagacgggctccgcgctgctcgaggcgagcggctggcatgtccggaccgatgcgctggcatcgctgctggcagcgctcgcgatgggcgcggcacggatcggcttcggccgtctcgacgacctggccgcgctcgcgatcggcgcgctcgtgatccgcacgggcgccggtttcatccggcgcggttacgcgcagtggccggcgctggcgtcgtgggcgggtcgctccacgcgcgggtcgtgaacgtgcccggcagcgcccgcgtcgggcatccggtctccgcgagcggctgcgctgaatgaaggagcggctcgcgcgggtgcgagcctctttcgcgtgatgtcgtcgccactgcgtggcacgtgacacgtggcacgtcgatcgctgccgatgtatcgccggacgaatgcggccggttccgatgaatcggcgtcggctgccgcttacccgagcggcacgacgctcccgagcagaatccgcacgagcgtcgcctggcgcgtgacgcccgtcttcgagaagatcgcgcgcaggtgcgtgcgcgccgtgttcttgctgatccccgattcctccgcggcctcctcgagcgtcagcccgttcgtcagcagcagcgcgagcgacgtctcggccggcgtcaggtcgaacagcttgcggatgatttcctgcgcaccctgcggcttgcggtcggggtcgcgcaggaacagcgtgacggccggccgccgcttgttgtcctccgaccagtcggacagcagcaccgtgcgcaccagcagcccgaggcgcggcttgtcgaagctgcgcgtgatcggcatcgcctcgacggtcgccgcggccgtgccgtggtgccccatcaccgcgtggcggatcagccgcttgagcgtgcggttctcctgcgcgtcggtcgcctcgatcgtgccgcgcgcaatcgtcagaccgttgttctgcttcaggatctcgtcggcgacgctgttcatgtcgatgatcgtgccgttctcgtcgagcgtgatcgtgccgatctgcatccggttgatcgcgttcgcgtagatcgagcgctcgacctcggccgtgtcgagccgcgaatgcagctcgaccgcacgcttcaggtgcggcagcagcaacgcgcagatcgccttgtcgcgcgcggagaactgtttcgaagcatggttgcggcatacgcggaaccggcactcgacgcccgacggcgtgcggagatccgcgccgaggatgtagcgcacgtcctgcggcttcaggaactgcttgtacagttcgctcgacagccagcccgtgtcgccgaacacgtcgtcgaccgtgaccacgcgatcggccggcaggccgacgaacggatcgagcgaatagtagtagttgttgtacgacgcttcgccgtcacccggcacgaccgggccgtattccgatgcgtgcacggacagcggcgcgcggcggtcgctcgcggccgcgcgcaggatcagcgtcacgtagttggcctgcagcaaccggcgaaccagctcgagcgcacccgcccacggcggcgtttccagcgggccctggtagatgcgcgccatcagctcgctgaaatcggcgacgccgatgtcggcctcgtcactggttgcctggctctcttgcggagcccatctcgtctccatcagcacgctccatcctccatacgacatgtttccgacgcgacccaaccgcgccgccatgattaagacgcgtctaaattccggcgtcatcgggagatttactgaatggtgagaattggccatccgggcgaaccgaccatcgtccgatcggatgatgtggcgccctgcccgctacgctggaatgcccgtcaggccgtgccggcaagcgtccggcacggactcaggaaaaccgcgacacgggtttacctgattcaaaccgcatccgattcagacaggagcccccatgccgctcgacccacaggcgcaggcgctgctcgccgcgttcgcccaggcacccgcgatcgatttcgcgcagctcaccgttcccgcgtatcgcgcgagtctcgcagccggcggcgcgttcgccccgggcgatgccgtcgccgccgaagaggactggcagattcccgcatcgggccgtcagttgtccgcacggctgtatcggcccgctgccgacgggcccttgccgctgacggtgttcttccacggcggcggcttcgtcgcgtgcggcatcgattcgcacgcgaacctgtgccgcagcctcgcggcccgtgcgcgcacgctcgtgctgtcggtcgactaccggctcgcacccgaggcgcgtttcccggccgccgcgcacgatgcatgcgacgccgtgcgctgggccgccgccagcgcgcgcgatctcggcgcacgcaccggcgcgctggcggtcgccggcgacagcgccggcggcaatcttgcggcggtcgccgcgctgcagttgcgcggctcgggcatcgcgatcgcgcaccagttgctgctgtatccggtcgtcgattgcgcgaccgagcatccgtcgtacgaatcgctcggcaacggctatttcctgacggcggacatgatgcgctggttcaagcgccactatttcgacgacggcgccgatcgcgcgtcgccgcttgcaagcccgcttgccgcgccggacgtcgcgggcgcggcgccggcgacgatcgtcagcgccgaattcgatccgctgcgcgacgaggccgaagcgtatgcgctgcgtctcgcgcaggccggcacgccggtgaccgtcgtgcgctggccgggccagcttcacggtttcgccagcatgctcggcgcgatcgatgcagccgaccgcgtgctgaccttcggcgccggcgcgctgcgccgcgcgttcgacgcgacggaggcgccatgagcgtcgccggcacgcgggagatcatcgacgagctgcgtgcgggccggatggtcctgctcgtcgacgaagaggatcgcgagaacgaaggcgatctcgtgatcgcggccgatcacgtgacgccggaagcgatcaatttcatggcgcgcttcgggcgcgggctgatctgcctgacgctgaccgccgagcgctgcgagcagttgcgcctgccgccgatggccgatcacaacggtacgccgttcggcaccgcgttcaccgtcagcatcgaggcggccgaaggcgtgacgaccggcatttcggcggccgatcgcgcgcatacgattcgcgcggcggtgcgggcgggcgcccgccccgacgacctcgtccagccgggccacgtgttcccgatcgccgcgcgcccgggcggcgtgctcgtgcgcgcggggcacaccgaggccggctgcgatctcgcggcgctcgcggggctcacgcccgcatcggtgatctgcgaggtgatgaacgacgacggcacgatggcgcggctgcccgagctgaaggcgttcgccacgcatcacgggctgaagatcggcacgattgccgacctgattcattaccggcgcgaacacgaatcgctcgtcgaacgcgtcggcgagcggccgctgcatacgccgtgggggcgattccgtgcgatcgagtatcgcgacaccgtgcacggcgcaccgcatctcgcgctcgtgcgcggcgagcccgatccgtcgacgccggtgctgacgcgcgtgcacgaatgccattcgctgctcgacctgctcgatgcggagccgtccgcgcattcgtggccgctgcatgccgcgctgcaacggatcgacgcggccggctgcggggtcgcggtgctgctcgactgcgacatgcgcggcgacgcgatgcggatgccggccggccatgcgcgccgcgacgggcgcgtgacgggaatcggctcgcagatcctgcgcgagctcggcgtgcggcggctgaacgtgctgtcgagcccgttccggttgcccgcgctgtcgggacacgacctggagatcatggcgttcattccgctcggcgacgacgatccggaaagcgcgcgaagcgcgcatgcgaacccgctgcgggcggcgtgacgcgttgccgcgggatggtcggcgggttgcccgcttgacaggctatcgtttgtttttgttagatacagtctttggtttgtattttgacaatacatgctgtagattgtattttccgattacaaacgatcgcctgtcattccgtggagcgcccgatggcctttcctgtccagaccctgacccagctgcgtccgatactcgtcggcttccggaaatccgcggggctcacgcaggcgcaattggccgcccgcctgggcgtcacgcagcaatcctacgcgcagctcgaagccaacccgtcggcggtcagcatcgagcggctcttcaaggtactgaacacactcggcgtgcgcatgacgctcgcgctgggcacgcaggacgcttcggcggcatcggccgatcctgcgcccgatgccgatgccgcgccggcggtccgccaacccgccgcgagcaaacgcaagccggatgcggcgcgcggcaccacggccgccaaaatccagcccggcctgcggccggcgccgcgcgcaagcggcccgcgacggcgacacccggcaagccacgggtttcgaagcgggaggactggtgacgatggccacgcgtgcccgtcacgaccggctcgacctgtggatgaacggcattccggtgggctactgggaagtccggcgcggcgtcgagcgtctcgtctacctgccggcctggctcgacgatccacagggcggccgctgtcgctgtcgctgcccttcacgcccggcaaccagccgcaccagggcgcgatcgtcgccgattatttcgacaacctgctgccggacagcgagccgatccgccgccgcatcgcgcagcgttaccggctccggtcgacggcgccgttcgagctgctcgcgtcgatcggccgcgattgcgtcggcgcgatccagatgctgccgcccggcgaaacgcccatcgatctcgagacgatcgacggcgtgacgctcgacgatacggccgtcgccgaggtgctgcgccacgcgaccgccgcgccgctgcccggccgtgcggagccggaagtcgacctgcgcctgtcgattgccggcgcgcaggaaaagacggcattgctgcgccagggaaaccgctggctgcggccatcgggcagcacgccgacgacgcacatcttcaagctgccgctcgggcgtgtcgggaacatgcaggccgacatgcggacgtccgtcgaaaacgaatggctgtgcgcgaagctcgtcgccgcgtacggcttgccggtcgcggcgtgcgacatcggccggttcgacgaccagaaggcgttgatcgtcgagcgcttcgaccggcgtgcttcgcgcgaccgcacgtggatcctgcggttgccgcaggaggacatgtgccaggcgaccggcacgccgtcgggcgcgaaatacgaatccgacggcggcccgggcatcgacacgatcatgggcatcctcgccaattcggccgacgccgcgcccgaccggatgaatttcttcgtcgcgcagcttgtgttctgggtgctggcggcgatcgacgggcatgcgaagaacttcagcatcgcgcacctgcccggcaacacgtaccgcagcacgccgctgtacgacgtgctgtccgcgcatccgatcatcggcacgcgccgcaaccagcttccgccgcgccgcgcgctcgcgatggccgtgtgcgggaagaaccggcactacgtgatcggcgagatccagccgcgccactgggtcgcgcagggccggcgcgtcggcctgaccaaagacgacgtgcacgccgcgatggcggccgtcgtcgctcgcacggaacccgcgatcgaggaagccgcggcgcagatcccggcggaatttccggtggatgtggcggatgcgatcttcgacgggatgcggcggcaggtccgcaagctccgggcaggcgatctcgcgtgacggatcgacggcgggcggtcgggatcggggcgggctttggcgtccggtggcaggcttcgatgtactgaaccgggcgcccgcccggaacgggttgtgccgggctcgtccacccggacgatgcgcgcctgcgccaccgccgcacaatggtcgccgtgcccaatcccgcccccgcccctcatggaatctgccgacctcacgaccgcgttcagcccgctgcagatcggcccgctgacgctgcgcaaccgcctgatcaagtcagccaccaacgagggtatgacaccgaacggcgtgccgtcgcgcgcgctcgtccgttttcacgaacgcatcgccgaaggcggcgccgcgctgacgaccgtcgcgtactgcgcgatcagcgacgacggacgcacgttcgtcgaccaggcacggctcgacgtgccgacggtccgccagttccgcgcgctgaccgacgccgtccatcgccacggcgccgccgcctccgcgcagatcacgcacggcggctgcttcacgttcctgccgtcgctgtcgacccgacggccgttgagcgcatcgggcggtttcaacaaggtcggcgtgatgagcggccgcttttgaagcaggcgatgacgcgcgaccagatgtccgcggtcgccgacgaattcgcgcaggccgcacgccatgcgcgcgacgccggcttcgatgcggtcgagatccacatggggcacggctatctgctcagccagttcctgtcgccgctgtacaaccgccgccgcgatgcgtacggcggcgacgcggcacggcgcgccgctttcccggccgaggtgctccgccgcgtgctcgacgcggtgggccgcgatctcgccgtcgtctgcaagatcggcgtgaccgaaggcgtgcgcggcggcggaaccgccgacgacgcatgcgagatcgcgcggcggctcgaagccgaaggcgcgcacctgctcgtgctcagcggcgggatgaacgtcgaatcggtgtggcagctgttcggcagcccgttgcccggcgacgcgcgcgcgaacgccgacaacgcgatcgtgcgtgcggcgatggcgctgcagaaactcaccgagccgaagatgggcgcgtttcgcgagatgtatttcctcgagcactcgaggaaggtgcgtgcgtccgtccggatgccgctcgcttacctcggcggcgtgcgttcgcgcgggaacgtcgagctggcgatgcgcgaagggttcgatgcggtcgcgctcgcccgcgcgctcgtgttcgagccggatttcgtcaacggactgcgcgacggccggctcgcgcagtcgggctgcacgtcgtgcaaccgctgtgtcgtgtcgatgtacacgccgggcggcaccgcgtgcgtcctgcacgagccgaacgaccccgcgccgaaccgggtgccggccgccggcgcgtgaggtgcgacgcggggcgcgggacgcccgatgcgggcgccggcgccgctcagccggcgtcgcgcgcgcgggcgagcgccgcgagattcccttcgccgaacccgtggtgccccttgcgctgcacgatttcgaagaagatctcgccgggccggcgcttgacgaaggtctggaagaacagcctcggcacgccgtcgccgccgatctcgccgtcgaccagcaccgcgcgacggcgcagcgcgtcgagatcgacaccgtgccccggcagccgcgcgtcgacgtcatcgtaatagcgggccggcggctcgatgaattcgacgccgttcgcccgcagcgcatcgacgcaggacaggatgtcgtcggtagccagcgcgacgtgctgcacgccctcgcctggatggtcgggcagatacgcgtgcatcagctcggtgcgccgcgtgccttcctcgtagaccggaatccgcaccgcgccgcacggcgacaccatcacacgcgattcctccgacacatgccagtgcgcgtcgatttcgtggatctcgcgaaaatgcagcaggtcgtggtagaaatccagccactcccgcatgcgccccgcgccgacggtctgcgtgaaatgatcgacctgctgcagcccgacgcccacgcagtcgagatcggtatgcgcggtcgcgatgtcgatcggccggaaatcgatgtcgaagatcgagatgtcgccgacgccgccccgctggccgtcgcgcccgcgccagcggtcgacgaaatagaggtgcgaatcgccgatgccctggatcgcggggatcttcagctcgccgacgccgaccttctcgccttcgaacgcccacgcaccgagctcgatcgcccgctcgaacgcgcgccgggcgctggccacgcgcagcccgatcgcgcagacacccatcccgtattcctccgcgtagcgcgcggcgaacgaatcgggttcggcgttgatcaggaaatgcatctgaccttgccggtagagcgtgacgtttttgctgacatgccgcgcgatcgccttgaacccgagctgctcgaagcgctgcgcgagcgcctcgggcaccggcgccgcgaattcgacgaattcgaggccggccatcccgagcggattggcggccggatcggcaacgggcggcgtatcgctggacaggggtgggaattgccgggcattccagtctccggggcatgcgttcgatggggatggcgcccgtcgctggcggcaaacgcggccagcgtggcgaccgcatccgccccgaacgggcaagttctcaatgctgcagattttaaccagatcgttcacggcggcacaccctggccaaacgggatatcgtcgcgccgcctagtgcaaacccgaaaagcgttcgataatcgcacggacttgtacgataatcgcgcactctgcccgattggccgattgccgccgtacggcgcgcgccctattctccgttcactcatcgacttcaatgcagcatcggacgcggcgccgccacgattccacgatgcgccgtgccaggagacaccgccatgaccccaaccttcgacaccctcgacgccgccgccagcgcccgcgtccgcagccaggcccgcaaggccgcgatcggcagcttcgtcggcgccgttgtcgactggtacgacttcctgctgtacgggatcgtcgccgcgctggtattcaattccgaattcttcccgaaagtcagcccgacgatgggcacgctcgcggcgttcgcgaccttcggtgtcggtttcctgttccggccgctcggcggcgtcgtgttcggccactacggcgaccggctcggccgcaagcggatgctggtcctgacggtgatgctgatggggctgtcgacggtcgcgatcggcctgctgccggcattctcgacgatcggctggtgggcacccgtgctgctggtgctgatgcgcgcgatccagggtttcgcggtcggcggcgaatggggcggcgcggcgctgatggccgtcgaaagcgcgccgaagcaaagaaggcgttctacagcagcggcgtgcaggtcggttacggcgtcggcctcgtgctggccacgggcatcgtgtcgatcctgagccacacgctcggcgaggccgcgttcaagtcgtggggctggcgcctgccgttcgtgttcagcatcgtgctcgtgctgatcgggctgtgggtgcgcaagaacatggacgaatcgcaggagttcgtcgagaaggtcgaacacggcaaccgcaagctgcgcctgccggtgctggaggcactgacgcgccatccgaaggcgttcctgctgatcattgcgctgcggctcgccgagctgttcacgatgtacatcgtcaccgcgttcgcgctcagctattcgacgacgaacctcggcatgtcgcgcgacctgttcctgaacatcggcctgctggtgggggcggtgagctgcgtgacgatcccgtgtttcgcgtggctggccgaccgctacggcctgcgccgcatctacctgatcggcgcgctgatcggcgtcgcgtccgcggtgccgttcttcctcgcgctggaggcgcggtcgatcgcgtggatcgtgatcttctcgatcctgctcgcgaacgccgcgcacgacatggtcgtgagcgtccagcagccgttgttcaccgagatgttcggcgccgaataccgctatagcggcgcgggcgtcggctaccagttcgcgagcgtggtcggcggcgggttcacgccgttcatcgcggtcggcctcgtcagcgtggcaggcggctcgtggcacctcgtcgccggttatctcgcggtgggctgcctgatctcgctgatcgtcgccgcgcggatgcgggcggcgcagtaacgacccgatggccggccccaaccgtggccggccatcacgcatcgctcgacggcgactgccaacggcctcggtgcgtcgcgcgcgacgtcaaacactgtcagttatacgcgccgattccccttttccctctgaacattccacgccgcccgccgaccaatggcatcatatgggcctacgtcagtcaccgatacgcccccatatcatgtcgaatctcatcgtccacggcggcactccgctgcgcggggacatcaagccgtccgcgaacaagaacgccgtcctgccgatcctgtgcgccaccctgttgaccgaccagccgttgcgcctcatcggcgtgccggacatcaccgacgtgcgcaagatcctcgacatcttccgcacgctcggcagcgacgtgtcggtcgacttcacgacgggcctgctcgaactccaccatcgcgacacgaaattcgatccggccgtccatcggctgccggaagcgatgcgctcgtcgatcatgctgatcccgccgctgctcgcgcgcttcggcgtcgcgcgcctcgagaacgacgtgaagggctgcacgctcggcgtgcgcgagatcgatccgcacgtcgaggtgttcgagcgcttcggcgcgcacatcgagcgcacgcccgattcgctgatcgtccgcaccgacggcccgctgacggccaacgatcactggctcgactacgcgtcggtgacgaccaccgaaaacttcgcgctgtgcgcgacgaccgcgaacggcacgtcgacgctgatgaatgccgcgtccgagccgcacgtgcaggagttctgccagttcctcgcgatgatcggtgtcgcgatcgagggaatcggcacgtcgcggctctgcgtgacgggcggccgcaagctcggcggcggcgagttccgcttcgccgaggatttccacgaaatcgcgacgttcctcgcgctcggcgcgatcacgggcggcgacatcacggtacgcaactcgtcgcccgaacacttcccgctgatcgaccgcacgttcgcgaagttcggcgtcaacgtcacgcaccgcgacggctggtcgcgcgcggaacgcgacggcccgctgcgcgtgcgccggccgttcacgcagaacatcctcaccaaggtcgaagccgcgccgtggccgtacctgccggtcgacctgctgccgatcttcatcgcgctcggcgtgcgcgcggaaggcagcgcgatgttctggaacaaggtctacgacggtgcgctcggctggtccggcgaactgtcgaagttcggcgcgcacgtgctgctgtccgatccgcaccggctgatcacgttcggcgggctgcagctgacgccggcccgcgtcgagagcccgtacatcatccgcgtcgcgatcgcgctgctgatggtggccgcgagcatcgaaggccgctcggaaatcatgaacgcgctgccgatccgccgcgcgcatccgcatttcgtcgagaacctgcgctcggtcggcgcgaacgtcgaatggacgagcagcgagtaagaccctgaaggtacggcgcacgccacacgagcgccataccgccacccgcacccggtcggcggctgtgtcagccgccttctcccgtccctccccgttactcaccgcccccgcaatcggcatcgccggcgcccatgtggtcgaacccgtagagcatcacggccgtcgtcccgcgcgccgggttgctcgggcgcttcgccaggctttcgtcgagcggagacgacggatactggacgctcgtgtccatcaggttgcccggcgccgagcgcaactccgcgtcggtcagcttgcgcgcttccgcgcgcggcagcccgaacgccttgcgcacgtccgcttcgttccaggttcccttgagcgtgacggtgaccatctgcaggtcgccgtgctcccagtccagttcgaccttcgtcgcgagcggatgcacgctggccgcgagccggtcggggaacaccgggccttcgtagtaggccttcgtgttcccgcacgcatcgccggtattccggtacttcttcaatgcgcaattgaagcgcttgtcacggtagccgaaggtcgattcgacgtagcagccgaacttcggcgacgtcatgcgcggccaggcacgcacgtcgacggccggcttcgggaggggcgtgccggacgaggattcgccgcggcaagcagcggcacggccgcgacgagcacggccaacacggattcgcgaattttcattgttgtggtccagttgaggcgccgattctaaacgacggacatgttccgggctcggggcacgcacccagcgccggcgcatgcaagcccggcgatacatcgcggcagatccgatttgcgcgataatcgcccactcatgcgcgattgccgcgcaccgggacgccaccttccgacgatgaaaaagcccgaactcgaccgacgcgactggattgccggcctcgaaaaaggcctggcgatcctcgaggcattcgacagccagcacgcgcgcatgacacccacccaggccgccgcgcgcaccggcctcacgcgcacggccgcgcggcgctacctgctgacgctcgaatcgctcggctacgtgtacaccgacggcaagctgtacggcctcacgccgcgcgtgctgcgggtcggctggtcgtacttcgattcggcgcgcctgccgcgcacggtccagccctatctgcaacaactgagcgcgtcgctgaacgaatcggcgtacgtgagcgtgctcgacggctgggagctcgtgttcatcgcacgcaacggcgtgtcgcgcgtgatgacgaccggcttcgtgctcggcgcgcgcgtgccggcgccgctcacgtcgccgggcgtcgtgctgctcgcccatcatcccgatcgcgaagccgtgcgcgcgtggctcgacgacaccgaactgccgccgttcacgccgcacacggtcaccaacaaggcgcgcctgctcgaacaggtcgaccaggcacgcgacgccggtttcgcggcgatcgaacagcaattgcaggtcggcgtgcgcggcatcgcggtgccgctgaagaaccgtcacggcgaagtggtcgccgcgctgagcacgaacatgccgatcggcgcggagacgaccgacgcggccgtgcggcgcgtcctgccgcatctgcaggaagccgcgctcgcgatgctcaacgtgctgtaggaaagttcgccgattgtcccgtctgccgcctgctcgtttccgcaaatcgctgaagtcgctgacggcctcgataccgtcatcgatcggatagaagacccacgccgctcgcgacgcgtcacggcaagtacatcgacaggccatcaccgcttcaccgcaacacctcgcgcagctgtgtcacggcggcgattcaagatcggggccaccgccgcgcacgatccgacgccgcatgagcagacaagatcggcgcgctgccccgcaggacgagccgcgcgccgagcctcgccactggctcgtggcatcggtcctcccgccaggaccacgcgcctttccaccctccttcaatcgagatccgcgccatcgcgattgagcaatatgcgaatgtcctgcccggcgatccgtctcgtttcaagatgctcgttgacggaaagcgccgccgcatgccctaccgcatgaccgtaggaaaagcattgcgcggtgacacgggccgatgcgacggcttcgtgctcggcagacaggcagcgcccggcaaacagcagcgattcgccggaggaagggacgaagcagccgaatggcacttcgtagaagtcgttgagcaaccattcgacgcgtggccggtttccggcatgcaactcgatcggccatggcgaccgcgcaatgccgtctgcgaatttcgcgccgccgagaatatccgcattgcgtagtgtcgcgacgccttgcgcctgccgggtctgccggacgcccacctggacggccgtgtcattcacccagctcgcctcgcaaccggcgaggtattggcggaaaaaccgtgcgtactcgcgcgcctgaatacgcccttcgacttcggcatccgagaaatctcgataaagcaccgcgttcagttcgcggccgtcgctccccgtgacacgcgtacagttgcacagcaattcgcccggccgcgtcgtcggaaacagccatatctttgtgcgcgggagccggtagccagaggtattcgcgtgcgcgatatgcgccatcacctcggcgggcatgatcgtgtctcgcccataggccgacacgaatcgctcgacgtcgacgcccatcaaccggaagatcatcgtcgggttctgcacgtgcccgttgtcgcccatgaaggtcggcaatccggccatcgcaaccagatccgcgtcgccggtcgcatcgatcgtcaccccggccctgacctgcaccttgccttccttcgtgtacagctgagcgcccgcgacacggtcgccctccatcaggacctccgtgacggtcgagtgatagatcgtcgtcacgcctgcttcggcgagcaatgcatcggcgctctcacgccaggccaacggttcgtgaacgcgcgtataggtcttgccgtacttgagcggcgcgctcagcccgtcacgccgctccatctgcgcaatgaactcgtcgacgaagccatgcaccagttgccgcggcggtgcgtcgccgtcgctggcctcgtacaggccgcagatcgtgccggacaatccggcgaccgcaccgccgccgcaaaagccgtaccgttcgaccagaatcaccctgcacccctggcgagcggctgtgacagccgccgccagaccggttgccccgccgcccgccaccaggacatccgcatgcaggacctgtacggggcgctggtccgagcaatgaaccgcgtattggatcgccatcgaatgatctcctcgttgggcgcccgcggccatcgcgaatcgtagccgcaggcgccatcgtcaatccgcaaacagctcggcttccatgagcttgagattctcggcgatccgcttcgggcgaaacgccatctgctcgagcacatcccgctgcacatcgatcccctttgccacctcggtcaggacaagtccgtccggctccacttcgaacaccgcgcgctcggtgatgattttggccgtctgcccgcgctccctgacgttcttcatcaccggataggtgatctgctcggcctcggacacgaatttcctgacccgcccttcgcgcgcgatgttgagcccgcctgccccgatctcggcctcgagcccggccgtcgtaaaggtgccggtaaagatcaggtcccgtgcgttgtatgcgatgtcgatgaatccgcccgctccggggttgaacgcaccgaaacggctgacgttgacgttgccggcggcatcgaattgcgcaaacgcgagtgcagcgaaccggcagtttccgccattgatgaaatcgaactggttcaggccgtcgagcaacgcctccggataaaggttcgcggaaaactgccagccgctcatcacgaggccgccgaaggtgccatgctcggtcgtcatccagtagtcgttgatccggtcgccttcgaacaggccgtcctcccacatcgtcagcggggcgtcggacgatgcaccgaatccgaagatactgaccgtctcgcgaggtacctcgcgggcggcccgtcgcgcgacgaccttgtcgatcgtcagcggcagcggcgcgaggccgttgaaggttggcggctgtccgcccaggtaggctgcgtcgaacggcgtatcggtcaccatcagttgctcggcgtcgacgacgacatgatcgaccagcacaccgggaatcttgacgtcctggacggcgcgcgtacgccgttcggtgatgcgctggacctgcgcgatcacacggccgccgcatgccttgacggcgagcgcgatcgcgagcgacgacgacatgagcgcctcgctttcgaacgacaggttgccgaactcgtccgcgctcgatgcgcgaatgatgccgacatcgagtttgcgcgtcggataaaacaggaactcttcgccgttgaactcgacgagcttgatcaggtcttcctcgctgcgcccggtcagcttgccgccatgctgacgcggatcgacataggttcccaacccgatccgcgtgaggtagccgggcccccgccgcgcaacttcgcgcagccagtgcatgctcgcgccgatcggccagctataggcttcgatcgcattctcccggatcagccgcatcagttccggccgtttgccggtgcgcggatcgaccggattgacgtacgagcccgatacgatgcgcttcatcagccccggcttggccacccagtccatgcccttgatccccatcgagtcgccggtgccgcaggaaaataaaacgagaggttcgagggcgaaccgacctgatcgtggcgctcgcgaatggcccgcaggatgcgatccggcgtaatccatccgatcacgccgacactcgccacctcgcagccatcgggaatcttcgatacggcttcctgcgctgtgcaaatcttggtcatgctttgactccgaaggcattgagggtcgccttcgcgaccggatgttcgcagttctcggcgaacaacagattggcttccgcgtcgcgaatctcgccgtgggcggcgaagctgtcgcggaaatagcgtttggtggcaacgaccgcgggcaacggatagctcgcgagcgtgttcgcgacctccagcgccatcggcagcgcgctcgcctcctgcgtcacgtaatcggcgagaccaaggcgctgcgcctcggcgccgtcgatggcttcgacgccccacgcgaggcgccgcgcggttgccggcgtgcatcggcccagcaggaattccaggccccacggcggaatccagccgatcttcacttccggcatgtgccatcggcacgtcgcggtcgtcacgacgagatcgcatgccgcggcaagcgccaccccgccgcccagcgcaaagcccgacaccgcacacagaaccggcttgcgaagcatcgagatgctccgcgccagcgcggccgtcaccgcttcgtgctcgcgcatctcggccatgctcatgttgcccagttccttgaggtcgctccccgcgcaaaagccgggttcggtaccggtgaggacgatcgcgcggacttcgtcgttcgcctcggcgtcgcgcaaggcggttttcaacccgcagatcaggtcggtgcccaacgcgttgcgacgcctcgggcgatcgatggtcaggatgttgaccgcttcttgatgctcgctcagtaacatgaaataccctccgaatatgctcaggtcgtagccggttcattggccgaggtgcgcgccgggtcgtttcgctcgatacgaatgaaccaggaagccaggatgccgacgaggacgcacccggcaaggaagatccagccgttcgaatagtccttgcccgccgaagtggtgacgatgaggctcgcaaaaatcttcgcgctgaaggccgcgacgacgtagccgacgccattcacgaatcccatggccttgccgtacacctccggggtgaagatttcggccggcacggtcaggaacggccccacgccatatttgcgaaaaagcccatcccgcagagcgcaaacgcgaggagttgctggttgccgtctcgcagtgtcgcgatcaccagcaggaacgggatcagccccgcgaagcaggtcgcgatcatgatgcggcggttgccgcgaaaaaccttgtccgacaggtaggaagacacgaagctgccgattgcgcccgccacgaaatagaggccggcccacaagcccatcgtctggatcttgaatccgaacttgtctgcgagatagatcggaatccatatcgatgcgccccaataggtcacctgcatcacgacgtcgaccacgacgaccgcgatataggcaggattcctgaacaagtcgaggaacgaaaaatgcttgaccttcaggatccggcgttgcacgtcggagaaattcttgccgtccagtacacccgcctcgatctcgtccttgtagctgtattcgagctccgcttgggtgatgcggggatattgttcggggcggtcgaagacgaaatacgcgatcagggccagcgggatcacgccaagcgcgccggaaatgaagaacaccagacgccagctacccgtgtgcgcggccagctgcgtggcgaagatgctggcccatgccggcgtcaggatccacgcccacgacagcagtgcctgcgcccgcgcccgcccttccttgttgaaccaccgcatcagcacgcgggccgacggaacgtactccgtgccgaccagtaccccgaacagcgccatccggatgaagtactcgttccgggtgtgcaggaaacccatccacgcggtcatcagcgaccacgagatgaccgagaagatcagcatcttcttcgcgccgtacttgtcggtcagcacaccggacacgtattgcgaagggccgtagaagatgagcatcaggaatgtgccggtaccgatatcggcggcgctcatcccgatgtcggccgcaatcagcgggttgagcagattggttttcacgcgatccaggaactggatgctgtaagccacgaacagtacggtggcaatgatccaccggtaatcgactcttgatttcatacggtttccttgcgattcgagttgctacgccaagcccacatcattcggatatcgctgatatgttagtagaatattaacgagaggctcgatcgtcaaagcgggtatacccgcgcaaccagacgcgggctggccggtatgcaggggttggatgcgcggcgcgagtcacgttaatatgtcagtgacatttttgaggcgatggcccatgtaccagacagaaccgaccggacagaccagcggatcgcttgccgatcaggcccatcagcaactggaagaactcatcgtgaccctgaagctggcgcccggcagcgtatggtcggaggtgtcgctcgcggagaagttgaataccgggcgcacgccggttcgtgaagccgcgcaacgattggccgcggcgcacctgctggagatcgtgccgcgtcacggcatcatgatcacggtgcccaatatccatgatcagttgctggtgctcgaaacacgccgcgaactggagcgcctcattgcccagcgcgcggcgcggcgtgcgctacccgacgagcggaaccggatgcgggaagtcgccgcgaagctcgaggtcgccggcgagtcgcgcgacgtgcttgcgtatcttcgaagcttgtatgtagccaatcggctcatggcgcagctcgcgcgcaaccggttcgcggcggaggccatcacgccgttgcatgcgctgtcccggcgtttctatttcatccatcacacggacctgaacgatctgctgaaggtcagcctgctgcacgcccgtgtcgcacgcgcgatcgccgacggcgacgagcgggaagccggactcgcggccgatacgatgatggactacgtcgacgcctttacgaagcaatcctttacacgtgatttcgagccgcatcagatctgatgtcgcgcgaccgcgtcgaactttttgatccacgaagcgattcgggcggaaacgcacgcggacaatgcgcggcaacgggcaccggccggttcgcgtacaccacgctcaggcggcccttgccttacccgatccgccaccatcgcggcagcagatcgcgcacctcccgccgccggtagcggtcgtcgatcagatgcacgacgccttcgtcgtgctcggtgcggatcacgcgcccggccgcctgcacgaccttctgcaagcccggatacaggtacatgtagtcgtagccgttgccgaagcgtgcgtccatcgcacgccgcatctgctcgttgacgtcgttgacctgcggcagcccgagcgtcgcgatgaacgcgccgatcagccgctcgccgaccaggtccacgccttccgagaacgctccgcccagcaccgcgaagccgacgccgcgcccgcccgcgtcgaagcgcgcgagaaacgcgtcgcgctcgccttccgtcatgccgggcgcctgcgcccagacgggcacgtccgggtgccgtgcctgcatcagcgcgaccacgcgccccagatagtcgaagctgctcaggaacccgaggtaattgccgggccgcgtcgcgtattgcgcggcgatcaggtccacgatcggttcgagcgaccggtcgcggtcgcgccagcgggtcgacacgtggctcgcgacgcgcaccgtcagctgctcggcgcggaacggcccgtcgacgtcgagccagcccgtgtcgccgggcaacccgagcgtgtcgcggtagaaatgaaacggactcagcgtgcccgagaaaagcacggtcgcgcacgcggcttcgtagcgcggcgcgagaaagccggccggaatcacgttgcgcacgcagagcgtcgactggacgcggcgccggcggccggccgacgcaacgccgtcgagcgccggctggcgcggcatcggttcgccgtgcagcgtcgcgtcgaagatcgacgcactgtcgaacgcttcggcaagcacgccgaactggatcgcctcgaaatgaaaccgcagcagcgcatcgccgttcgcgcgcggcgcgtcggccaggtgctcgccgaccgccgcgacgaggttctgcaacgccgacacgatcgggcccggtatctccggatacgcggcatagcgctcggcctgcgcgcggttgaccgtgccccacgcgcgggcgagccggtcgaaggccttgcgcagcgcggcgggtgcggcctcgcgcgcggccgcgaatgcgaacggatcgagcgatgcgctgtacatcttgcgcgcacgatcgagcaggttgtgcgcttcgtcgacgagcacgccgacgcgccactggttctgctgcgcgagcgtgtgcagcatcgcgctgccgtcgtagtagtagttgtagtcgccgatcaccatgtcggaccagcgcgcgagctcctgcgacaggtaatacgggcagacgtcgtgcgcgagcgcggccgcgcgcacggtgtcgcggtcgagcagcccggcctcgatcgccgcgtcgcgcgcggccggcagccggtcgtagaaacccttcgcgagcgggcacgactcgccgtggcacgcactgtcgggatgctcgcacgccttgtcgcgcgcaacgagttccagcacgcgcagcggcagcgcgggcgtgccggcgccgagcgtcgccgccgcttcgagcgcgagcgcgcggccgggcgttttcgcggtcaggaagtacacgtggtcgagctcgccctcgccgcaggccttcagcaacggaaacacggtgccgagcgtcttgccgatgccggtcggcgcctgcgccatcagacaacgatcgtcgcgggccgcgcgatagacggccactgccagctcgcgctggccgctgcggaactgcccgtgcggaaacgcgagcgcgcgcagcgcctcgtcacgcgccgcgcggtgcgccgtctcgcgttcggcccagccgacgaagcacgcgcactgctcggcgaagaacgccgcgagctctgccgcccccagcgtttgcgtcagcaccgtctcgcgctcggacacgatgtcgaaatagacgagcgcgacatcgatttccgggaggccgcgcgcgtcgcacatcaggtgcgcgtagaccttcgcctgcgcccagtgcagtgcgcggtggttggccggcatcgcgtcgaggctgccgcggaaggtcttgatttcctcgaggcggttcgccgccggatcgtagccgtccgcgcggccgcgcacggtgagcgtgccccacgtgcccgtcagcgcgatctcggtttcgtagcgagcaccgcggttcgacgtgaccgcgccgtggccggcgatgccttcgagcgcggtgggtgcgggcgtgaagcgcaggtcgagatcgccgcgccgcgcggtgaactcgcacatcgcccgcaccgcgacgacgtagctcatgcggacaggcccgccgcttcgacgggcatgacgtccgcgccggcccattcgacatcgatcacgcgcaccggaatgccgtgcgcgacgcagtatgcgagccagcgcgtctggttgtcctgcaggcggtcgccggggcctttcacctcgacgagttcgtagcggcgctcgccgggccagaagcggacgagatcgggcagccccgaacggttgctgcggatatccgcgagcaggcgcgtgaaccacagccgcagatgctccggcggcaggcacgcaagcgcctcgtcgagcagtgcgtcactcagcacgccccagaacacgaacggggattgcagccccgccttcgtcgcgaaatgccggcgaatcgtctcgcgataagcgcccgaatcgagttgcgcgaagcacgcggcgaatgcatccgcacggcgcgcggcgaaatcgggcgcgtgcaggtcggccgggccgcgctggaacggatggaagaacgcgccgggtaccgcggcgaacacgggttcccagcacagcagcccgaacagcgaattgatcagcgtgttctcgacgtaatggaccggcgcagccggttgcgcgagatggtcgcgcaccgcgaattcgacactgacgaatgcatcggggcgcgcgagcacgagcgtttcgcgcggcacgtccgccgccgaagccgcgcgttcgacgcgccggccgagccggcgctgcaggcgcggcagcatgcgctcgacacgctggcgctcctcgtcactctcgaaaccgccgcgcgcctcgagcgccagcgcgagcgcatcgtcgtcacgcccgcagcgttcgagcacgcggatgcgccgatggcggctgccgggccaggcgctgcgcacatacgcgtcgagcgcgccggcccagtcggcccggcgctcgcacgtctgcccgagtgcgaacagcagcttcgcgcgacgcgtcgcgagccagggctgcgcgcagccgaccgcgtcgatcgcgcgcaccaggtcgtcgaacggcagatcgtcgggccatgcgtcgagcgcatcgcggcacgtctgcagcgcgagatacgcgtcgacgtcgccgcgctgctggaacgcgcgcgacgacggcgcgatcggcacgctttcgtactggaacacgccgagatcggcgagcacgaattcgctccagtcctggtggagattgccgaagaacatcaggcgcagccggtcgcacagcgcgccgaccgtcacgcgcagcacgcggtcgccggcctgcgcgcaccacgcgtcgagcggttgcgcgatgtcgtgcgcgggccgcagccgttcgagccactcggccttgcgctcgcccgcatgcgcggcgagtgccgggaagatacgcagcagatcggccttggtcgacagcgcgaacagttcgtcgagcgtcagcgcgggggccggatcgacccagccgagttcgacgagcggcgcggccgcgtcgagcgcgcagccgatctcgtcgtacacgagcttgctcgcgcggaaatcggagccgttgcgcatcagcatccggacgagcagcgcgcgcgacgcctgcggcagcgcggcgaactgccggacgaacgcgtgttcgtgcgcatcgaacaggtcgtcgtaacgcgcgccgagccaggccagcgcgcgttcgaaattggtcaggtagtaaaacgccgggggcgtcggcgaagcaggcgtcacggggattgatcactgtacatttgtacaggtcggaatcatatcaaatgtgacgggaaataccgctgccccgatcgccttcctgctgcccggccttgctcagaactggtaattaaccgacatgtcgaacacgccgttggtcgactgctgcgtgatcgggctgcgcgcggcgcggccgacgagctgctcgatcgcgccgtcgatcgtgatgaaccagtgcttgttcacgaaccaggccatggtcacgcccgcaccgtacgacttgatcccggcccctgacgaatacgccggcagccccgaacgcgcggcggcccctggttcacgccgaaccagctgttcatgtagcgcgaatcggcgaacgacacggtcggccccgcgaaccagaagaaatgctcgttgctgcccggcagcggcatgtacgcggagaaatcgccgacccagccgttcgagccgccgatgctgcgccggatatccgcgcgcagcacgagcggaaactccttcgagatcacgtaatcggccgccagtttcatcaccggcgccgcgttgatgttgtcgaggccgttcaggtgctggatatcgtcggccgagcggcgcccgaggtcgtaaccgacggacaggctcacgcgccagttcggcccgcgcagcacgttcgcgccgagcccctcgcccgtcgacaggaagaacaggtcgcgatagcggatgtcgaggttcgggccgcccatcacgcgatagcggtcggagcccgcatagcgcggctgcagggtcatcgcagcgcccacgctgatattccacgtggaaatgttcgggtcgaacagtttttcgagcggcacacccgccgagtattgccactcgccgagcggcgaaggcgtctgggccgacgcatcgcgggtgccggccgcggcaagcgccgcgcacgccgacaggccggaaacgaaccggcgtgcgccgggtgacagcaacaggcgagcaactgtggccaaggtggtctccgtcggttgcgcgaaacgaacctgaaggaaagcgcatcgcgcctcttcggccgcagcggctgccaggctgcggcacgaacgtagcgtgtgctgaattaacggacatcctacgcgacgcgcacgcagacgcaaagcgcccgctgcgcgcgggcactttgccctgcatggggatcgaccggcgaagcagggatgaatcagaatcgttcgacgtgatagtcgccggccagcgcggccgggctgcgtgacgacatcatccgcgagaagccgtcggcgagccggccgagcgccagctgcttctggctcgcatcccagtgcgtataggtgtcgtacgcggcatcgtcgaacgacacggtgacggcagccgggcggccgctggcgcgatagccgatctgcagcacgccgcccggcagttcctcgatgtgatagcgcagcgaacgcgattcgaaatagcggcccagcacctgagcgatcgcgcgcttgtctggcgattgcacgtgaatgtccatgacggtcctccttttcaaggttcgcgcggccggtcgcggtgcaccgcttccgcccggcatccgcatcggcggcgggttcgacggcgggtcgccctgcggcagcccgtcaggcaccggcgggtcgaccggatcgtcgtgtccgggcggcggcgggtccgggtcgacgtcgggagtcgtcggctcggggcggtgcagcatggatggcatattcatgtcgctcctgcgcggcggcgtgcgcatttcgatggcgcggcgagcgcgcaagcagcatgcctgctgtcgcacggcgaacgtcggcggcttcgctcagtcgtcataggccgccatcaccagccacatcgtgcgtctttccgcggtcagctgcaccgcgagcgcgtacgggtcggacggcgcgcattgttcgacgagcgcccgctgcgctccgggccgtcgtagacggtgcggttcagttcgcgtacctcgtccttgccgtcgaacatgcgccgctcgggccggtagaccagcgattcgcgtttccacgtgtcgaagcgctcgcgcacgtgaccgaaatcgccgccgcatacgttcgcgtcgtaacgtatcctttccctggatgcatccatcacgttgtcctctcgttcccgccgacggcgcgtgcctcgtggccgcaccccgtccgccgccccggcgcgcaagcgccgtgccgccgaagcatgacgggcacggcgcttgcgccttcaatcgccatcaaggatggttcgaccatgaccgttcacgcccccggccgccaccacgccgtgccaccggctgccggactgctctggctcgccacgtcgcgcccgccgtcgaaagacaagacggaggagcgcatcgacgagggactcgaggagacgtttccggccagcgacccgcccgccgttggcggcgcgacccgtatcgaccctgccaggccgtccggcgagcacgaacgccgcgcgccgcacgctccttcccgccccgcgatcacggctgacggcggcacccggctcgcgctgcgcggcggtgcagcggtgcgccggagcaatccggagttgatctgatgaaacgccttgaacgcagatggcatgaaatcagcggcgccgccggcgtcgcggcgctggcggcaatcgaaagcgcagtggtgctcgtgatcgtcgcgatgacgggcatcggccactgacaccctgtacggcccgttcgcggcttgcgccgtggaagatgtacaagcgggctggcaaatttctccgtcgcacggccgtcgaggcccggcgtgtgccccggcgtgtgcggtacgcgcgcggcacgccgtctgcttgcacatcgtcccgctcacgaaggaggcttcatgtatcgcgtcaccgagatcatgtcgcgcgacgtggtgtgcgtcgcgccgaccgacacgattcgccacgcggccgagctgatgcggcgcttcgatatcggcgtactgcccgtttgcgacggcgacgaactcgtcgcgatcgtaaccgaccgcgaccttgcagtgcgcgggctgtcgcacggccattcgttcgatacgccggtgcaggcggttgcgtcgaggcccgtgcaatggtgcgtcgaggacgacggtgtcggcgacgtccagcaacggatggccgacgtgcagctgcatcgattgccggtactcgaccgtcaccggcggctggtcggcatggtgtcgctcggcgacatcgcgacgcgcgcgggcggccccgagcgcgacgaactggccaatacgctcgaggacgtgtcgctgccgcgccggcgctgaccggcgccgttcatatcggcgacccgcccgggtgccgcttcgaccaggaggtgttggatgacaaccgacagaccgtcgcgcgacgccacgcgcatcgtcggcgacgaccgccgcacggccggcggcgggccggggcccgacgtgatggccgcccgcacgctcgaaggcgatcgcgtgctgacgatggacggcgacgacatcggccaggtcgacgacatcatgctcgacgtgcgttccggtcgtgtcgcgtatgcggtcgtttcgtcacgcggccggccggggatcggcgacaagctgcttgcggtgccgtggaacgtactcgtgctcgacgtcgagcgccaatgcttcgtgctgcccgtggccaccgaacgggtgcgcgaagccccggcttcgacaggaatcgctggccggcaatggccgatccggactgggccgaggcgctgcatgcgtactacggcagttcgccgtactggctcatcgaggaaggcgaaacggcgctcgactcgccgccgtacgaggcgtcgccggaaggcccggaaggcggcaagcggtaacgcgatcgtcggtcacgccggtcagtgcgcggccgccaccgtccgctcgagttgccgggcggctgccagatgcgcgttgagcatcggcagcgtgttggccgcgaacgcgcgaagctgcgggtcgcggccgttccgtgcctctgcttcgtagagccggatcgccgcttcatgcgcgcgcgggcccgccagcgcgacataggccgtgtcgaacgcgcgcccctccctggttctcaatgccgtgacggccggatcgacgagcatccgcgactgcaccggcaggcccctggccgccccgagttgctgcaattcgccggcgatccgtcggtgatcgtcgaccatccggcgcgcgaacgccttcacgtccgggttcgacgagcggtcgagcgcgagctggctggcctgccgctccaccttgccgatcatgccggccttgtcgacgaactcggcatcgataccggtcggccgctgcgtcatgccggcctcgtcggccgtcgtgccggggcggatcacacccggcccgacctgcgccgacgaagcgggcgacgcctgggccggcggaaacgcggcggccagcaggccgacggtcgcggccagcacggtcgccgccggccggcgggttcggttcgctttcattccgacctccgtgtgtcgcgacggcacgcgccggttgcgcgggctcccgtcacgccgggcgccgggacgacgtgaagaaatcggtccacgcgccgtgtcgccacgccccctcggttcgttccaccgacagcgcgccggcggcaagcatcgtccgctcggcgaagaccctcgtgcgtcgcgtcacatgcgcggcgagcacgacaccgttctcgcactgctgcagcgcgccgcggccctccggcgcatcgccgcgcatcttgccgagcgcgccgcacaacgcgccgacgtaaccaccgaccagcggcacaccgacccatgcatgcagcgaatggaatccgcccacgtggagcagcgtggctccggccagcccggcaatcgccccgatcgccacacccgccagcgcgccctgcccgcccggccgcgcggcggaatccgcatacgcgtcgccgccgagccagaacagcgcgtgctgcccgggcggattgagaaagaagactttcacgtcgtcccgatgcacgaggtggccgcgcagttgctccgcgcaatgttgcgcctgctcgagcgtcgaaaaacggccggcaatgatggtgtccatgtcgatccctcctgcccggcaaagtaccggaccgggccgcgcgcacgcggcgcgcgaccggcccggtgctttgccggtgcctcacgttgcttccggcggatctgccgcctgtcgaacacgccgctcacgccgtcgacgtcgtgcgctgccgctcgtcgggtacgctgcccgacagttcggccacgcgatggcgaacctgcacgtcgatatcgcccgatgccccggctatccgccgctaccggacatgcgggttccgatcgtgcccggcatccggcgcgacatcggcgatcacgctcgccagcgtcggcatgtccaccggcttgcacagatacgcgtcgaagccggcggccatcacgcggtgccggtcggcgttgccggcgtgcgccgtgaccgcgacgacgggcaggtgtccgctgccgcccggcaaatgacggatgcggtcgagcagccagaaaccgtcgccgtcggccatcgcgagatccgacagcacgacgttcggcgcatcctgttccaccacttcgagtgcgtcgtgccccgattgcgcggtcgacacctgcgcgcccatcgtttcgagtgccgcggcgaggctcgcgcgcgaggtcgcgtcgtcgtcgacgacgagcacgcgccggccgtcgagcgccaccgtatccggcgtgcccgccgcgtgcagcaggtcctcggcaggatcgtcgacatcccaccgggtcggcagcgtgaccgtgacggtcgtcccgcgcccggtgcccgcgctcgtcgcgacgacttcgccgccgtgcagttgcgcgatgttgcgcacgatcgacaggccgagcccgaggccgcgcctcggcgatgcgaatgcgcgttcgggccggctgaatgtctcgaacaggtgcggcaggtattccggcgcaataccctgccccgtgtcggcgaccgacagccgcacacgctcgcccgcccgggtcagcgacacgacgacgcggccgccggacggcgtgaacttgatcgcgttcgacagcaggttcgacaggatctgacgcacgcgctcgcgatccgccggaatcacgcaggtcgccatttcgtatttcgtcgagagatcgagcccgttcgcctgcgccgtcgcgtcgagttcccgcatggcatcgcgcacgatccgcacgagatcgaccggcacgcgctcgaggcgcaatcggcccgtcgcgagcgacgacgcgtcgagcaggtcggccaccatgtgcgacagcgaccgcgcgctgcggtcgatcgcgtcgaccgcctgttgcgcgagcccgtcgccgtcgacgttgcgcagtacctcgacccagccgtagatcacgttgagcggcgtgcgcagttcgtgcgacaccgtggccagcagttcgtccttcagccggttcgacgcgtccgcctgtgcgcgtgcgtcgcgcgcgccgcgcagcgagcgcatgttgcgccgctcgccgcggcgccgttcgtgcgcgtcgcgcagcgtcatcgacagccccgtgcagtcgccccgcgcatcgacgatcggcgacgcggcgaaagtcgcacgaaagcggccgccgtcgcgccgtacgcacagcacgtcgaacggaccgaccggcgcacgtagcgtcgcgaacgatccggacagcggatgccgccgcaaccagcgcggcgcgatcagctcggcgacgtcgagcccggcggcctgcgccgcatcgatgccgaagatccgtcgcgcggccgggttccagctcgtgatccggtgtgcggtatcgacgccgacgatcgcgtcgggcgacgcatcgaccacccggcgcagcaggccgtcgtcgggtacgggtacgggcacgcgcgcggccggcgaaggctcgccatgcggctcgcgggcaccggcgtcgccgtcatcatggaattcgcggagacgatcgctcgcgagcagcggcttcacggccatcacgagcacgcactcgacgaagctgatcgcgacgaacgcgccggcctgctcgagcagcgtggccagcggcgcgttgcgccaccagagcgcgcagatcacggccacactcgcggcggccgcgaccaggccgccgccgaacgacgccagccatgcgacggccgcaacgcctgcatagaaaggcagcggcgcaaatggcgcgtgcccgccgacgacgcgaaccgtccacgcctgcagcgcggacgccagcccgacggccagcacgacccatgcaccctgccgtaacagctcacgggtcagggtcctcattgcatccttgcctcgcgccggctccgtcgcacggcgtcatgccgcttgccgaccagcctgccgtcgagcgtgccgggcgagcctgatggcacccgcaagcgacatgcccgctacgtgtttcaggcggtgggccggcgccagcctgccaggctgctccgaaggccgcggccggtcgggcgccggccggtatcgggtacgcatcgacgcaaggcgtcgcgaccgtctttttcatcggcgcgctgtaaaaagcaccgatgtgcgcctggacctcggaagtgccgcgattcgtgccatgaatcgatggcctgtttcttccgcccccgccacacacattggaaatttctattccgcggcaccttcgtggtcgtttcgctgtcgatgataaatattgcaatcaacggaacgggtgatgccgattttcaaaacgacccgctaatgccgatgggagataccgcaaaccgttcgaagcagcgtgcagacgcccgccgtttgtcgggccgttcgtccgcaatgcgcacgctgctcggccgcatcgaaaaattgcgccgacccgcgccagcgtgatgattgccggcgaaagcggggtcggcaaggatatcgtcgcgcgccggctgcacgatctcagtgcccggcgggacggcccgttcgtgcccgtgaactgcggcgcgattccgcccgatatcgcggaatcgcaattgttcgggcacgagaagggcagctttaccggcgcgatcgcgcagcggaaggtttcttcgaagccgcgcgcggcacgcgctgctgctcgacgagatcgcggaaatgcccgcgtcgctgcaggtgaagctgctgcgggcgctcgaatcgaatgcgatcgtccgggtgggcggcaccgagccgattccgctcgacgtgcgcatcgtgtcggccacgcgccacaacccggccgaagccgtgcgcgacggccggctgcgcgaggacctgttctatcgcctcgccgcgttcgcgctgtacgtgccgccgctgcgccagcgcgacagcgacatcgagacgatcgcgctggagttcgtcgacgcgctcaacgcgcggcaccgcgcgcacaagcggctgaccgacgcggcgatcgcggcactgcgcgcgtattcgtggcccggcaacgtccgcgagctgcacaacacgatcgagcgcgcgtacatcctgtcggacgaaggcatcgacgtcacgctgccgaagcccgcggtgccgcccgagcgtctgtcggaggacacgatggcgctgccgctcggcgcgacgttgcaccatgcgcagcagcgcttcatcgcggcgacgctgcgccacttcgacggcaacaagccgcgcgccgctaaagcgctcggcatcagcctgaaaacgctctacaaccggctcgcgctgatgcgcgacaacggccgctcctgagcggcgcggccgtgtcgcccgcgcaccgcatgccgcggttgcgcggtgcgcaacatgaattacgcgaccttgaaccgcccgaccgtggtcgcgagcgcgttcgcctgcgactgcagtgcggtcgcggcggcggtcgactgttcgacgagcgccgcgttctgctgcaccatttcgtcgagctgcgtcacggcgcgattcacttcctggatgccgcgcgtctgctcgttcgccgcgtgcgtgatctcggagatgatcgtcgtcacgttcgacacgttggagacgatctcgcgcatcgtatcgccggcctgacgcacctgcccggacccggccgacacgctcgcgaccgtcgattcgaccagtaccttcacttcgcgcgcggcctgcgcgctgcgctgcgcgaggctgcgcacttcctgggcgaccaccgcgaagccgcggccctgctcgcccgcgcgcgccgcttcgacggccgcgttcagcgcgaggatgttggtctggaacgcgatcccgtcgatcacgccgatgatgtcgccgatccggcccgacgcttcctcgatcttctccatcgtcgcgacgacgtccgacacgaccacgccgccgtgcgacgcgatccgcgacgcggctgccgcgcgttcgtcggcctggccggcggctgccgccgactggccgacggtcgcggtgatctcttccatcgatgcggccgtttcctcgaggctcgccgccgccgattccgtgcgcgacgacaggtcctggttgcccgccgcaatctcgttcgcggccgtgcgcaccgattcgctcgcatcgcggatctcgcgcatcacgtcgttcagcttgtcgacgaagctgttgaacgagcgtgcgatgtcggccacttcgtcacggccgtcggccggcaggcgctgcgtcaggtcgccggcgcccgagccgatcgcagccatggcctggcgcacttgcgacaggcggcggaacgcggtcgcggtgatcgcgccgatgatcagcgacgcgacgccgacgatcacgagcagcgtgatcagcgaagcggtcagcagcgagcgcatcccggccgtcgcctcgtacttgtcgagcagcaccagcgcgtaccagtcggtgcccggcacgggcgcgcgcgcaccagcttcgcgtcgccgccgacgctcacctcgaccggcgcggtcgcggccgcgatcgtcgcgccgttcgtcgcgccgagttcgggcgacacgtcggcgaccggcttcagcgtgagcttcgggtccgggtgcgcgaccacatggccgctgctgtcgatcaacatcccgaagcttgcgggcgtcgggtggatcgacttcacgttcgcgatcacggtgtccattgcgacgtcggcggcgacgacgcccttcagcgtaccgtcgcgcaggatcggcaccgcgaacgtgacgacgaggttgcccgtgccggcatcgacgtaaggcggcgtgacgaccggcttgccggcctgcgcggcctgcttgtaccacgggcggccggtcggatcgtagtcgggcgggatgccggtcgggtcggagaagtggaacgccttgtctgcgtagcccgcgtagacgttcgtgaagccgccggccgtggccatctgcttgaacaccggcagcggatcgggcgtcagcgcggcatcctgcagcgacgcgatcatccggctccgggtggcgacccagtcggcgatcccgaccacgtgtccgcttgcgacggaggtcaggttgcggtcgattgcgtcgtcgttgtacgagcgcgcgatgaagtagttgatgagcgtggtggcgacgagcgcgaatacgacgatggcgacgcacgcggcgagaatgcgggcgcggatggacgagaacatggcaacgactcggtaagggagcgcgaacgcccggtggacgaattcaccgggtaaacggcaatcgcgccgcttacttgaggccactgtgacaattcagtgaaacgtctgacaaaacgcaatgccaatcgtcagctgatcgtcggcgaatcgtcaggatgactgcgcggtcctgcgacgcgcgcgcacgccgccgggacgcgacgacggtacctgcgcgcttgggcaggatgagtcgaaaaggaggtcgagacaggccggttctcggtcgacggatgcatgcgtgtcgattggaacccggccgtggcgcggcgacggatcgcgccgcgcccgcgtcatcagttgcggcgcgcgcccgtcacaggcgatggcccggacgcggatcggcttccgcgggcggcccgtcggcccgcgtgtcgttgtcgagctcgtcctgccggcgcatccgttcgcgcaggtgccggatcgcgaacacgtggatgtaatcgtgcacccgcgcgtcggacgacaatacgcgcacttcgtcgtcgagcatcgcacgcaactgatccgcgccgatcgcgcgctgcctggcggcttccttgagtgaatcgagcaaactgtccttggacatcgacagactcctgacggtcgaggaacgaaaagaagaaggtactggaagcttaaagactgaacggccgcgcagctgcgatgcgccggcgcgtgtttgcgcgcgatcaacggcacgttgcgtgccgtcgtgccgatccgtccccgaaccggccgcgcaagattcgcggcgcaaacgacccgcgaacgagactggaaacctgccacgccaccccggggcgcggcaccggccggcgggcgaacgatgggacgctgctcgacgccgatgcatccgcgaacttagaccggccgaaatcatgcgtcaagcgcgctgcgccacgcgccggccattcgtcggaacgaacgggccggatcgtcgcccggacggccgatcgggcgccctgcgtgtcagcggattccgatacgcaccgcgcaatccctgacagcgagttcagcgcacgctgcttggcagggtaccggcgccccacgatactggtgacatggacgaaacgttcatacaggtcatcgctcagccggccgtcgagccggcatgcggggcctggcgcaggagaccaaccatggcacatcgcaacttaccgggccgggacggccaacggcgcgcgtcgggcaacgcacgcgccctgcccgcccaggccgtgccggccggcaaccgtccgtcggacgatatcgacaccttgcttgcgcttgctcgcgaagccgggttgctcgtcacgctcgacgggcagatcggccgcgagaagtaccagagcgtcgcgggctcggttctcgcgctgcaacggttcgccgcggcactgtgcgcacgggccgcacccgacgcgccggccgcggtcgaggcacgccgcaaggcgcgccccggctggccgcatgcaaaccgcctgcgcaaccgtacatgcggcctatgcgcgccgctgcacgtcgcgcgccagcgcccgcgggtacgccgcggcgcaggccggcgacacgacttgcggtcgatgcttcgcaccggctgagcgggcaagcggccggcacggcacggggccgtgcaatggctgctcaccgcgcaacgtcggccgcgcctgccgcacgccgagcctgtaggacgacggcgcggcaacggtgagcccgccgcgaccctcaccgcttcgcatcggcgcaaccgcgcgccatcacgcatcaccacgcgccgttccacacggtcgcaatgacaacgattcctgcggggaatgcacgtcagacggggccaacgacaacaccaacgcggaaagcggacggggtgacttgcaccccgcccgtcctccaaggcagccgacggctgcctaccctcgtgccagagagttctcggccggatgacgcgccgtgcatcgcacgtcgcggctccgaaaatgatgtgatgccggtgaatgcaccgtcgatcacggccttcgacgctcgcgcggctgcgcggtgcatgcacgacagaccggccgcgcggccggttgttccgtcaatgtctcacgcgatacttgcgccatttctgatgcagatcaaaccaggccggtttcgatctcgacaccgcgcgatttactcggtaccgcgcacgagcagcacgggcacctgggcgagatgcgccacgcgacgcgcgacgctgccgatcagccaggcggcgatgccgcgccggccgtgcgtgccgaccaccagcagttcggcacgccagtgcacggcgtcgcgcatcagtgcatgggcgacgtcgtcgctggtcgggcgggtttcgacgataccgcgcttggtcgggttcccggtcgcatggaacagcgggccgatcttcgcgagtgcatcctcgccctccgcgcgataggcgtcctcgagcgcgcgcaccggcacgatatccgtcagacgaaccgcgcgatcgatcacgtatgccgcgtacagcaacgttgtcggcgtcgcgaagccgagcccgacgcgcaccgcgtgcagcgacggctcgctgccgtcgaccgcgaacatcagccgctgcaggccgccattcgacggcagcgcataggcggccggcacgatcagcagcgcgcagcgcgcgcgcgtcgtcagcgtgtccgacatcgcgccttcgacgagccgcagcagcccgtgatgcggattcgcgccaactatcagcacgtccgcacgccattccgacgtatcgttcaccagtgcatcggccaccgagccacccgtcaccgacgtatcgacgatggcctgctcgacctcgatcccgctatcggcgaacagcgcagcgatccgctcgttggtggcttgcgcttcgcgcatcatgtcctcgcgcgcggacgtcagcagcgcgtcgatgcgcgggatgtcgggcaatacgaggcggggttgtcgatagcgcagacgatgcgcaatcgcatgccgggacgcagcagcgtgcgcgcgtagcgtgcggcggacagcgattcgggcgtcggatcgacggccagcgcgatccgcgcaagcgtcgggatgggctgggcaagctgcatggcgaaggcctccgtgcgtgcgcgtcgtcgtggaacgacgacgggagcttcgcgcggaagcggcgcgcggcggccggacggccgccgcggtcgcggggatcggcgggtgtcacgcgaagcgcggacaatcgatgcgttcagcataggacgtccggcccgcgcgtgcatgatcgcgatcaagggtcgcgcgggcccctgcccgcgccgcttacgacttcgtcggcaccgatgccgccgggcggttcgcgtagaacagtgcatacgcgataccgagcagcacgatccacaccggcccgatcacgagggcgacgcgcgtgtcgggcgtgaacgccatcagcacgacgaccagcacgagaaaaccgagggcgacgaacgaaccgagcggatagaacggcacgcggatcggcaggcgcgcgatcttgtcggccgacagcgtgcggcgaaagcgcatctgtgcgatcaggatcacgcaccacgtccagatcgcgccgaacgtcgacaccgacgtgagccacgtgaacacgtgctgcggcgcgagatagttgagcagcacgccgatcagcagcagcgcgaccgagacgatcacgccgtacaccggcacgccgttgcggttgaccttgccaagcttgctcggcgcctggccctgctgcgcgaggttgtagagcatccgcgcggtgctgaacaggccgctgttgcacgacgacagcgccgcggtcagcacgacgaagttgatgatgccggcggcagccgggatgccgagccgcgagaacgtcatcacgaacgggctgccctgcgtgccgatctggtcccacggatagagcgacatgatcacgaacagcgcgccgatgtagaaaatcagcacgcgccagaacaccgagttcacggccttcgtcagcgacttctccgggttgcgcgcctcgcctgccgtgagaccgagcatctcgacgccgagatacgcgaacatcacgatcggcagcgcggcgatcacgccgttgatgccgttcggcatgaaaccgccgtgcgcccacaggttcgacaggccgatcgcgacaccgccgttgccgatgccgaacgcgatcatcaacccgccgccgatgatcatcagcacgatcgtgacgatcttgatcagcgcgaaccagaactcgaattcaccgtacagcttgaccgcgatgaagttcaccgagcccatcgccatcagcgccgcgagcgcccagatccagttcggcacggaggggaaccacatgtgcatgtagacgccgaccgcagtgatttccgccatgcaggtgacgatccacacgaaccagtaggtccagccggtcaggtagccggccagcggcccgaggtagtcgcgcgcgtagcggctgaatgcgccggcgacgggattggcgatcgccatctcgccaagtgcgcgcatgatcaggaaaatcgcgatgccgcccagcaggtaggtcagcaggatggccgggccggcgacgcggatcgcgctggccgagccgaggaacaggccgacgccgatcgtcgcgccgagcgccatcaggttgatgtgccgctcttccagcccgcggtgcaactggtcttctggttgtttcaagtccgtctcctggcagccgtgaacgggccgccgtcattgtcgatatcaatgcgcgaccgttcatgccgaacccggcataccgaaaacgaaataatctccgctgtcattttccgaataagaaatgaaacggatactgcgtcaatccgatcggaatcgccgcggattatccgcatcttccggaacaatccggaaaacggatcgggcctttcacggaatacgcccgttcggcccgtgtgacgcggctgagcgcgtaacggacggcaccgggatcaatcgctttcggcgcgaacgaacacgcgtcgaatgtgcgcgatcatgcgcacgcaatatgcaggcgggattatatggaggatcagcgttttcgcgccagccgattttcgtggaaatcgtggcgggtgaaatccgcggcggaattcgaatgcgcgcgtatctcgcgcgtggatttatttggacagcgtcgcgcgcaccgtatattcgccttcgagcgccccgtgttccggccgcacgaaataacgcgacgcgtcgagatcggccggcatcggctcgaccgggtagccgtgcttttcccacgcatcgaggccgcccttcagcgcgcggatgttgtggatcatcttcttgcgctgcatcttcgcgatcaggcgcttggccgtggcttcgttcgggcacacgcaatagacgacgatcggccgcttcagcagttcggggtcgagcaggtccggcgaatcgagatcgaccggcaccgcgccggcgatccggtacggttcgcgctcgcgaatcgccttcggccgcgcgtcgaaaatcagcggcggctcgtccgacgtcatcatctcgacgagctgcggtggcgaaatgcgcacctgcgcgagataacggcggaactgcacgcgacgcacccagcggtacagcaggaacgtgatgaagatcgcgaggaacgcgtcgaggatcgtgccgccgctcgcgcgcacccacagcacgaactggacgatctggtcgtgaatggccgcaccgccgaccagccagaacgcggcccacagcgacgcgccggccagatcccagaacaggaacacgccgacaccgatcgcggtcgtgccgagcagcggcgccgacacgagcccgaggcccggcaggaacttggacagcacgagcagcggcgcgccgtacctttcgaatacgttacgcgcgaaacgcagcgtggtgtcgagcgacagcgagaagcgcacgaggccgttcagcaggcgccggccgcgcgtgcggcccatgaagaaccacagcgaatcggccagcatcgtcgcgccgatcgccgccgcgaacatgctgacccaggatgcctgccccattgccgccatcgtgccgccgagaatcagcatcggcacggccggcaccggcacgccgagctgcgtgatcaacacgctcgcgaacacggcccacgggccgagcgacgatggaatagcgatgggaaagtgccacacggcggcgctcctggaagacatgcggccgcgcgacgagggccgtcggaccggctgggcagcggccgccgcggcacgtccgcagccaaccagtgcatgacgggcattctaaacgggtttggccgcgatcgcgcggaacccgcgccttcggcgcgggcttcaggaggctgccggcaccgctgtagtgctcatgcgtccgggcgctgcgcaagccgcgcgacgtgttccgcgtagtcgggaaacgcggcggccagcgcggctgcgtcggccagttcgaattccgcgaactcgaaacccggcgccaccgtgcagccgacgagcgcgacgtggtccggcgccgcgcagcgcgcgccgaaccagctcccggcccgcacgaccgcctggaacacggtgcccggatgcgtgagcggattgcccagccggtggatcgtcaacccgtcgcgctcgtcgagcacccatacctcgatcggatcgcccgcatagaaatgccagacttcgtcggaacggattcgatgccacgacgagtaagcgccatcgcacaacaggtagtagatcgccgtcgacgcggcgcgcggcgcgccgtcggcgggacgcacgaccgaatcggtcgcacggtaggtttcgcggaaatagccgccctcggggtgcggctgcaggtcgaactggcgaatcaggtcggtagcggaaatcggcatggcggatgacgtcggtaaggtaaggaaccggacacccggcgcaccggatcgcttcgcccgtcgcgaacgcgaccgcatgccgccggatgccgctgggtcgaacgccgcggccatgcgcgcggcgaacaagcggacaccggccgatgctgccagaactgcgcatcgggatgcaaccatgggcacgcgattgcgcccatggggcgcatcgggtgtaccgccctcgcccggccggtgcgacggtaacggccgtcgcgttcacacgccgagcgtcggccggcgcgtcgtgcgtttccgtttcgtcaggccgtcatccggcgaatccgcgcgacagccgccgcccgcagccgcccatgcgtcggcgccgcgcccgcgtacgtcacgcagccgacggcgcgcccggctcgctgtgccgcaccagcagcacgggccggtcggccgcgcgcagcagcgattcggcgacgctgccgagcagcagcctgcgcaggccgtgccgcccgctcgtgcccatcacgatcaggtcggcatcggtttcggccgccgtgcgcatcagcacggtggcgacatcctcgccgtaggcgtcgagcgcgcgcacggtgcccggcacgtgctcctgggcgagcaccgctttcgcagcgtcgagcaccggcgtcgcggcatcggtcgcggccgcatcgccatcgcgctcggccgcgaaacccgcatcgacgtcgacgagctgcggccggtgctcgacgacatacgcgcaggtgacttcaccgcctgacgccgccgcgatccggatcgcctcgttcagcgcgagacgcgcgctcgggctgccgtcgagcccgacgaaaatccgcttgtacatggtccgtccctccgaccgggcacgcctcgcgcgtcgcgcgacggcggcccgttatcgccacccggcccggtgccggctggcctgccgaacagtctgccccacgtgccgacgcgcccgttgatgcgcgtcaagtgcggccggcgcgcccgctgcttcacgccggttgccgcaatttctagtgaccccattacaaaaacgtgtaaatcgcgcacaatttcatcttgaaattagacgttgcgtgcagccggtgcgagttttgcccggttttgctgcgctgcccccgtgccacgggcggccccgacaacagaatggccatcgaatgaccgccagtggaaccccgacgcgtgacgcccgagggcccacgcgcctccagatcatgttacgccagccgctcgcggccggcgtcgttgcgctgtgcgccggcgcggcgctgtcgctcggcgtcgcgctgctcgtgcgcgagcagtggcaaggcgccgtccatacgcgtttcgaacgccgcacgtcgcacgtgacggccatgctccgccacgagctgcagtccggcgttgccgtgctcgcaggcgcgcgcggcgcgttcagcctcgtcccggacatgacgcccgagcagtggcgccggtacgtggacacgctcgatctcgacagcggccgctcgccggttcgccagatcggctatgcgccgctgccgcccgcgacccgcaccgcgctcgccggcacgaacccggtgccggccggcacgctcgcgaccgcggtgctcagcgcgccggcgtcgaattcgcccgtcgtgcgcttcggcgcctccgacgctgcgccgctcgcgcgcgcgcagaccggcgacatcgcgctcggcgtccacccggccgacgacgacacatcccgcgacgcccgcaccttcacgctgttcgtgccggtcgccgcgtcgccgcatgcggccgccccgccgtccggcacgcgcgaagccgccgccgacggggtgctgttcgcggcgttgagcccgcgtcgcctgatcgagcgcgcgctcgacgcggaacgcggaatcgacgtgtcgatgaccgccggcggcgaccggcgtgcgatcgtcagcgtcgaaacgacgaccgacgaggcgtcggcatcgcccgacctgatgcggcgcaccgacgagctgaacttcggcggcaccgtgctggcgctcgcctattccgcggacggccgcccgagcgcaaccggcgcgcaacgcgcggccggcaccgtgctcgccgccgggctgatcgcgtcgatcgcgttcgcgatgctcgtccacgcactgctgcgccgcaccggtgccgccgattccggtgcgagcagccgcggcatcctcaacgaggcgcggatgatgggcatcatccgttcgtcgatggaagcgatcatcacgatcgacgagaagcagacggtcgtgatcttcaatccgatggccgagcaggtgttcggcgtgtccgcgatggaagcgatcggcgcgccgctgtcgcgcttcatccccgaacggttccgcgccgcgcacgcgaagcacgtcgaccagttcggcgtgacgggcgtgtccgaacgtcagatgggccgccagcgggtgctgttcgggctgcgcgccaacggcgaggagttcccgatcgaggcatcgatctcgcagatccgcgacgcgtcgggcaagctctacacggtcatgctgcgcgacatcaccgagcggctgcgcgcggagaatgcgctgaagctgtcgcgcgaggaattgcgcgaactctcggcgaacctgcagaacgtgcgcgaagaggaaaagacccgcatcgcgcgcgaactgcatgacgacctcggccagcagctcaccgcgctgaagatggatctgtcggtggtcgaacagcaactgcgcatgcccggccgcgcgctgcccgatgcgggcgtgctgtcgcacctgcagggcatgcggcgactgatcgacgcgacggtcgcatcggtgcggcgcatcgcggccgacctgcggcccgtgatgctcgacgatctcggcctcgtgccggcgatcgaatggctcgcgaacgatttcacgaaccgctacgggatcgacgtcgagcggcacatcgaaacgggcggcctcacgttcaccagcgcgggcgcgaccacgttgttccggatcgtccaggaagcgctgacgaacgtcgcgcgccatgcggatgcgacgcgcgtcgcgctgcggctcgacgtggaggaaggcttctgcgtgttgcgcgtcgcggacaacggccgcggctcggcacccggcggcccggcccacgaagacaaatcgttcggcctgatcggcattcgcgaacgcgcccacatgctgggcggtaccgtgacgatcgacaccgcgctcgcgcgcggtttctcgatcaccgtcgcactcccgctcagcaccgtacaacaggaaacgctcatcacatgatcaaggtgctcatcgccgacgaccatacgctcgtacgcgacggtctgcggcacatcctccagaacgccaccgggttcgaagtggcgggcgaagcctgcgacggcccgtcgacgatcgcgctcgtgcgcgccacgcccgcccaggtgctcgtgctcgacctgtcgatgccgggccgcaacggcgtcgaactgatcaagcagatcaaggacgagagcccgcgctgcgcgtgctcgtgctgaccatgcacgcggagcagcagtacgcggtgcgcgcgttccgcgccggtgcgtcggggtatctgacgaaggaaagcgcgagcgccgagctggtcggcgcggtcacgaaggtggcgtcgggcggcgtctacgtgagcctcgcgatggccgagcagttcgcgcagagcctgaacgagccggccgagacgttgccgcaccagcggctgtccgatcgcgaattcgacgtgttccggcggatcgcggcgggccagacgctgaccgagatcgccaacgcgctgtgcgtgagcgcgaagacggtcagcacgtacaagacacggatcctggaaaagatgcagatgccgcacgaagcggcgctggtgcgctacgcgatgaggcacaagctgctcgacgaaacggacgacgtctagcgacgtctggccgcggatggcgtgcgccgcccggccgcgggcggctcaccacgcctacttcgcgggcaccgggcacgcgagatcgccttcctcgcacgacagatagcccttcagcgtttcggtgcgcgctttcgtcagatcgtcgaggcaggtcgacacgaccatcggatacgcgctgccgccctcggcgttcgcgctggagaagctgcattcggcatcgcggtacgcgatccacgcacgctgcgcgttcacgagcttctcggcgagcggccgcgcatcgcgcaggcgcgcggtgacggcctggtagatccggttcagttccccgtcggatttcctgtacgcgcgatcggcgcacgccgtcatcgccgcctgatccgtcgcgtcggcacaattcgtctgtgcatgggcgacgttcgccgccagcgccagtgcgcacagcaaaccggtcaagacacgcatggatgctccttgttgttcgttgaagtcgtggaacccggtgccgggcctgtcgcgctgtcgcgcatcggccgccgtgcggcggcgataccgatcgcgatgctagcgcacgcgcgccggcttgtcagccggcatcgcagcgcccgcgacggcttgcatatcggccccgcgcacctacactggaaaatcgatacgccgcttcaggcccgcgctatcgcatccatcccgtctccgcttccgcgcattcctcagcgcatttcgcgttcgcatcgccgagcggggtgacgactcgtcagtcaggttcctccacccggcccaacgtgctatcgccgtcgctccctggagggaatcatgagctatcacctggaaggccgtctgctcgaggtctgcaactgtcgcgtactctgcccgtgctggatcggcgaggacccggatttcggcgtctgcgacacgatcgtcgcatggcatgtcgacaagggcaccgtcgacggcgtcgacgtgagcggcaacacgatcgccgccgtgtgccgcgtgcccggcaacatcctgcaaggcaactggacggccgcgatctacgtcagcgacacggcatccgacgtgcaggagcaggcgctgctgaaggtctacaccggccaggccggcggcccgatcgccgaactcgcgaaactgatcggcacggtcgtgtcgatcgaacgcgccccatcgccttcaacgtcgaagggcacgcggcacgctgtcgatcggcaccgactaccacgcggaactcgagccgtatctcggcccgagcggcgcgcagacgacgctgaccgacaccgtgttctcgacggtacccggcgcaccggtgttcgtcggcaaggcgccggtctaccggtcgaagaacgcggcgatcggcatcgacgtcgatctgaagaatcacaacgcgctgcagagcacgttcctgttcgatgcgtgaagcgcgattgcacgcccacggtcatggccgcttcgctgcatcggcgcctgtttccgctcgtgctcgcgagtctcgtcgcgttcgcgtggctcacgctgtgggcatggacgcgcagcccgtacgggcgctacctcgaccacggcgacagcgcattgtccgcaccgttcagcgcgctatgccgtgcgctgccgggcggcacgctgtggctgccggccgcgttcgacgcggcaggctggacgctgatgatcctcgcgatgatgctgccgacgacgttgtcgctgttcgatgcgttcgcccgcgtcgtcgcgagccgccccgaccagacgcgcctgctcgcgctcgtcggcatcggctacgtcgccacgtggagcggtttcggcctcgtcgcgcacggcctgcacgaactggtgctggcaggtgtcgcgcgcgtgccggcgctcgcgtggcgcggctggctgatcggcgcggccgtcttcgcgctcgcgggcgcgttccagttcagcggactgaagacgcactgtctcgatcgttgccgcacgccgttcagtttcgtgatcagccgctggcgtggccggacgccgatgcgtcacgcgtttgcgctcggcgtcagccacgggctcttctgcgtcggctgctgctgggcgctgatgctgctgatgttcgtcgtcggcgccggcagtctcggctggatgctggcgctcgccgcgttgatggcactcgagaagaatgcggcctggggccaggcactcaccgcgccgcttggcgccgcgttgttcggtgcggccgtgctgatcgttgccagccacgcgtgaggcccgcgatgcgaccgcttgcctccacgttcgcgctgcatgtccggccgggcatgcgcgtcgccgcgctgacgtcgatcgcgatgctcgcgttcgcgtcgaattcgctgctgtgccggctcgcgctgcaggccggacgaatcgacgcggccagcttcggcagcctgcgtctcgtatccggcgcgctgatgctcgcgatcgtcgcgcgcgcgggggcgcggcggcccgccccgcctgcggactggcccgccgcggcgatgctgttcgtgtacgttgcgtgcttctcgtttgcgtatctgaccgtcagcgcggccaccggcgcgctgatcctgttcggcgcggtgcagctgacgatgtttgcggcgggatggcacgccggcgaacggtttgccgcgaccggctgggccgggttcggagcggcgctcggcggactggtgtatctcgtgtcgcccgggctcgccgcgccgacgccgcgcggcgccgcgctgatgacggctgcgggcatcgcatggggaatctattcggtacgcggccgtcggcccgtcgatccggtcgcggcgaccgccggcaatttcctgcgcgccgcgccgctggcgctcgcgctgagcgtcgcgctcgccgcccgctttcacgtcacgccggccggcgccgtactcgccgtgctttccggcgcgctgacctcgggcctcggctacgtgctctggtatgccgcgctgcggcacctcacggcgatgcgcgccgcggcggtccagctctccgttcccccatcgctgcatgcggcgcggtgctgttcctgtcggaacagccgacctggcggctcgcgctcgcatcggccgcgatcctcggcggtgtcgcggccgtgctcgcgacccgggcgcgccaggcgggcagcagccgctgatacgcatcgggcgcaacgcgctcgcgcccgacccgacgattcaggcagccaaaacgcaaaacccgcacacggacaccgtgcgcgggtttcgaagagacggcaagcgccgggcgcccttgcgggcgctgccaggcttagtggccgaagtacaccgacgaacggtcggcggcggtcggcacgagcacgcgctgacccgactgcgacgtcccgacggggttcgagccgtagcccgttgcatcggcttgcgcgccggtgttctgtgcggcggcgatctttgcctgcgcggcctggatgttttccgggtaattgatccagtcgttcgggttgtaaccggccttttcgagctggaccagctcggcgcgcacttgcgcgcgcgtcagcggctgctggctctgggcgaacgaaacgaccggtgcggccaccagggcggccagtgcaactgccttgatcagcgatttcatgatgcgttacctccaggattgttttgtcaggcgcttcggactcggggtcgttgcgcatgagtagaagtctaggaggcggccctatcagggtaaatacttaaatcacgaattcactgttgacggaaaacatacaatcgtcgcggaattcactgaatcgtcagacgattatcggcgttcgcgcaccgaataccgcgatacggtacccggcgtgccccgccggacatcagcgccccgacgacgccatcagccggtcgaacagcagcgccttgaggcgaatcaggtcgtcggcgccggtctcgccgaacgccgcgtgatgcagcgtcagcgcgggcgccgccgggtcggcatggacggcccgcaccgtgccgtcgagcgccagcagctcgatccggccgcccgtcgcgtacggcagcagcacgcgcaagggctcgccgatggcggcaatcggccggtcgacggcaatcgacagcccgctcacgctgatgtcgtgcaccatcccgatgccttccgcgccctccgctccgcctgcgcagcaggcggcgatccgcacggcacgcgcggctccgcgcgtgtgcgcaggcggtcgacgaaacccggcggcgacaggaccagaaaccgcgcgccgcctgcctcgtgcaccgattccaccgtcgcaccgaaacgcgacaccgcggcgcggccgatggccaccgcctcgatgtcgtcgccgctcgcgaagtcgaacgcggccgccggctgcggctcgacgaacagcgcacccgaggcggcaatgccgatcagccggtagcgctgcagcccgcgggtcgtgccgacccggcggcggatgccgatcgcggcgcccgccgacaaccccattcgcgtggcatgcggcaccgcgtcgggcacgcgcggcgcggtttcggtttcggctacggcttcggtgtcgtcgcgccggcgtaccggccggaaatggtcgaacaggaatgcatgctgcgcggcatcgcgcagcgtcgtgcccgccggcagcagcgcggcgccgtcggcatcgtagagatcgaaggcgaacgggacaccggcggcgagatcgtcgcgcgcgagtgcgacgtagtcggaagatagcctcatcggagaggcgcggagcgaccgcgcgagctgtcgtgacaccatgattacggcagccgcgcgcgaaatctgaacggctccgttactgcgaagcgccgctcgcgtcgggagcggccggcacgggcggctgggccggtgcagccgaaggggcggcggccggcgcagcaccgaggcccgaactgcccccgcctggcgtgctcgcccccgctggcggctgagcgggctgcggttgcgatgcgccagccgacagcgcggcagccgacgcggccacttcggacgccggtacccattcctcgacgatgccacccgatgccgcctccggcgcggaggcggccgaggcggtcgattccgtgccggtgtcagcctcgggcgcgcgctccacccgctgcgtcctgaccggcgcgggcgccttctcaggcttgggcgggaaccatgtgtcgaacaggtccgtcacgcgctcgcgcagcgacgcgaaccagcccggcgacggctcggtatcgaatttcgccttcgtgtcgacgatccgggcgcgctgcgcacgctggaagaaatcgccgacgatcggcagcgcgctgtgcgcgccctgccccagtaatcgctgcgcaacgtcacgcggccgtcgtcgaaaccgacccacgcgccggcaacgaggccgggctgcatcaggatgaaccagccgtccgcgttgtcctgcgtcgtgcccgtcttgccggccacgtcgccgcgaatcccgaagcgcgtgcggatgctgccgcccgtgccccgcgtcacgacgtcgcgcatcacgctgagcagcgtcttgtcggtctcggcgtcgagcgcgcgctcgggcggcgccggcgcgtactcggcgagcacgtcgccctggcggttctcgatgcgcgtcaccatctgcggctcgacatacagcccgccgttcgcgaccgtcgcgtacgacgcgaccatctccttcagcgtgaccgggctcgtgccgagcgcgagcgacggcacgcgttcgagcgggctttcccgcacgcccatgtcgcgcgcgagcctggcgacggaggccggcccgaccttctccatcacctgcgcggtgatccggttgcgcgacagcgcgaccgcgtcgcgcagcgtcatcggcttgcccgtcggcggcacgtcgtcgttcggccgccagatctcgccgcccttcaacgggatctcgaccggctggtcgatgaacgtgtcgtccggtttcatcccgttcgcgaacgcgacgccatagacgaacggcgaacgtcgagcccggctggcgccgcgcctgcgcgacgtggtcgaacggctcgctggtgaagtcgcggctgccgacccacgcgcggatctgcccgttgcgcgggtcgatcgcgaggaaaccggcctgcacgtcggtcttggtcttgcacagcgcacgcatgaaaccgcggtcggccgcgagcagcttcatcgcggccgcgtcgtccttgccggcgtcctgcgcggccttgtactcgggcgactcgcgcatgaaggtgcggaatacctcgttgtcggtgccacagccgtcgcggccgctccacgcgttgttcgcgatgccctgcaactggttgccctgcagcgtgagcgcctgcgtcgccatctgctgcagccgcgagtcgatcgtcgtgcgcacgatcagcccgtccgcgtagatgttgtagtcgttgcggtcggcccacgcgatcagccatttgcgaagttgctgcgcgaaatgcggtgccggcccgggcggctccttctggcgctcgaaatcgatccgcaacggccggcgctgcaattgcgcgaactgcgcgggcgacagcttgccgtacttcaccatctggccgagcaccgtattgcgccgctgcagcgcgctcggggttcagcaccgggttgtagtagctgttccccttcagcatcccgacgagcgtcgcgctgtcgagcacatcgagctcgtcggcggacttgtcgaaataggtgcgcgcggccatctcgacgccgtacgcgttgtacaggaacggcaccgtgttcaggtaggtctcgaggatctggtccttgctgtagacggcctcgatcttcagcgcggtgatcgcctccttcaccttgcgcgtgagcgtcggcgcgcggccgatttcgtccggatacaggttgcgcgcgagctgctgcgtgatcgtcgagccgccctggcggctgcccgagaacgtatggagcgcggccgatgccgtgcgcttccagtcgaggccgtggtgctcgtagaagcggtgatcctcggtcgcgatcagcgcgtcgaccatgtgcggcgagatctgcttgagcggcacccattcccggttcgacggcttgaattcggccagcagcttgccgtcggcggacagcacctgcgcaggctggtcgacacgcgccttgcggatgtcgccgatgcccggcgtaaacgggatgagcacgaccacgtacaccacgaacagcgccggcacggcggcgcccgcgagcagcacgccgcggcgcgtcggatgacgcaggtggtgccacgcaacggcggcgagaggcttgacccgcgcgacggcggcagccgcgacgggttgggcgcgcgcgacccatctggcacagaagtcacgcactgacgacacgtttcggcgattcacgcgggtggagctcggctgaaaagggtgcatcgtaccaaactcgcgcggcccgtcgaaccgcgacggcgtcgcgcccacctgcacgggcggccgggcgccggttcgcacgcaaagggcgcgctccctgacgggaacgacgcgccaagcctggtacgacaaacgggaagccgcgcaacgcgcggccgatcggcgcggcgactcagcgcacgagaaaaccgtaggtcagcggatcgcgctcgtcgacgatccagttcgcgaacccgcagatatgcgcgctgccttccacttccggaatcacggcgggcatgccgccgaccgtcgtttcgcgcagcacgcgccccttgaagaccgtgccgacgatcgattcgttgacgagcgtgtcgccggccgcgagcaacccgcgctggtagagctgcgcgacccggccgccggtgccggagcccgtcggcgagcggtcgacctcgcgatccgcgaacacgcagcagttcgcctgcgtcgagcccggatggcgcggcgcgttcgcgatgatcgtgccgtagatgtggttgatttccggaatctccggatgcacgaccgggtatttcgcgttcgcggcggccttcacttccgcgccgaagcggatcagcctttccaccgccgcttcgcgcaccggcaggtcgaacggcgcgccgtcgacgtagaaatagaacgcgccgccgtacgcgatgtcgccggtcacggtgccgaacgacggcgtctcgaccgacacgtcgcgttgccagatgaacgacggcacgttgacgaagcgcaccggccccgcatgctcgccgtcccacttcacgaaagcctcgatgaagccgcacggcgcgtcgatgccgacccgcgtttccggcaccgtgcgctgcacccagccgagctcgacggcggcggtcgacagcgcgatcacgccgtgtccgcaatggtcgctgtagccttcgttgtgcacgaagatcacgccgaaatcggcattcggcgacaccggctcggtgaggtagccgccgtacatgtcggcgtggccgcgcggttcgaacatcagcgcgcggcggatctcgtcggcgttctccttgagccacgcgcggcgctggacgatcgtgtcgcccggcagtctcggcagcccgctcgtgacgatgcggaacgcttcgccgcccgtatgcacttcgacggtggaaagggatcgggaaattttcatggtcgatcggatgcgtggaaacgaaggacggcggtcgcgccgccgtccggtgacaggcttgtgcggcgcttggtgcgtcgcttacttcgcgtacggttccggcaggccgttgcggatcacgtagacggtcgtcggcgcgcccttcaggtcgccgttcgcgtcgaacgaataggtgcccgcgacgcccgcgtagttcgacttcgcgagctgcgcgatcagcttcgccttgtcggtggtcgtaccggccttgaccatcgcgtcggcgagcagcttcatcccgtcgtagtagttcacgccgtagacctgcgtatcggtgtgatacgtgtcgtggtacttcttcaggaattcgcggccggccgccgtcttctcgagcgcgacgccgccctgcgcgcagtagacgatcgatgccgcgtcgcccgcgaccttgcccatgtcggccgagcagatgccgtcgccgccgagcagcttcgcgcgcaggccgcgctgcttcatctgcttggccatcggcgcgccctgcgccgcatagccgccgaggaagatcacgtcggggttgctggccttgatcttggtgaggatgccgaggaaatcggtggccgacgagttcgtgaattcctggtcgacgatcctgatcccgttcgccttcgcgacgttcatgaactgctcggcgacgccctgcccgtacgcagtgcgatcgtcgatcacggcggcggttttcgcgttcagcgtcttcgcggcgaacgtggccatcgtgccgccgagctgctcgtcgctcgcgccgatccggaagatgttcttgaagccctgcttggtcagcgccgggttcgatgcgaccggcagcatcggcacgccggcattcgagtacacgcgcgatgcgggaatcgcgacgcccgagttgtacgggccgagcaccgcgacgacgcccttgtcgacgaggttctgcgccacctgcacgcccgctttcgggtcggcctggtcgtcgtcggaaaccagtttgaacgtgacggtcttgccggcgaccttgatgccggccttgttgagttcgtcgacggccaggcgtgcgccgttttcattgtccttgccgttcgcggcctgtgggccggtcagcggcgccgaatggccgatcatcacgacttcctgcgcgtgcgcggaagtcagcgcgccggcggtgatggccaccgaaagcgcggtaacgaggtgtcgcatgatgtctcctgattggttttgtgtgaaaccaatgtaggacacgcgtggtcaccgcgcaagcaatttcaaaataaagtgttcgattctggtcatttttcagaccagaacgatttcggcacggtcacttcggcgcgatgtcgcgccgcacgcggcggatgtgctgttcgacatagaacgccgccgcatcggcgtcgcccgacacgatcgcctcgtagatcagccgatgctcggacacgtagagccggatccggcccgcgtcgtagatgccgtcgtccttcagccgcttccacagcggctggtccatcgtcttcgcgacttcgtccgcgatcttcacgatcagcgcgtcgcccgtcatcaacgcgagttgccggtggaacaaccggtcgctctcgttccacagcgcccgctgatgcggatcgtcgacgtcggtaatggtttccatctgcgccaggtagcgttcggcgccggggtcggcccggccgtgcgcggccgcgaggcgcgcgatcgccggctcgaggatcaaccgcacgtcgagcgtcgacgtcgggctgaaatcggcttcggacgcctcgtgcgtgtcgccgcgctgcgcgagcacgtcgagcggcgccgcgacaacgtaggtgcccgaattgcgcttcgtgaacacgagcccttcgttctgcagcgcgccgagcgcttcgcgcacggccggccggccgacctggaacagccccgcgagctcgcgctcggacggcagccgcgactcggcggcgtagcgccccgcgcggatctcgtcgcggatcttctcggccacctgctcgtagatctgcagcggcttgaaaccgccttcgagtgagtcgggacgcgcggacatcatcgtgtagctcctgcccggtcgagggcgtgaatctggaatgggttcgcactataccggagcgcgccggcatcgaggccatggcggctcttctggacagatattagaaccaaaaccggcaaggcgctttattttctgggttgcagacgggccagcaagtggtatagattcgatccacactgccctgtgtcacggtacccggcagatttgtggcgggcgcggcacgcgcccgtcgtccacgctcaccgacgcatgcgacgtacacgatgaccacgctttccccgattcccgttttcgatgcggccgacacggccgcgctgctcgactacccggcgctgctcgccacgctcaggcaggccgtcgccgactatgcggcgggcgagatcgtcagccccgagcgcctggtcgtgccgctgcaggccggcggcgtgatgctgtcgatgccgtcgagcgcgcgcgacctcgcgacccacaagcttgtgaacgtgtgcccgggcaacggcgcgcgcggctgccgacgatcctcggccaggtgacagcgtacgacgcgaccaccggcgagatgcgctttgcgctcgacggcccaacggtcaccggacgccgcacggcggccatcaccgcgctcggcatccaggcgctgcacggcgccgcgccgcgcgacatcctgttgatcggcaccggcaagcaggcggccaatcacgcggaagcgctcgcggcgatctttcccgacgcgcgcctgcacgtgcgcggcaatcgcgccgacagcgcggcggcattctgcgccgcgcaccgcgcgcacgcgccgcatctcgcaccgctcgacggcgacgcggttcccgattcgatcgacgtcgtcgtgacgctgacgacgagccgcacgcccgtctaccgcgaagccgcgcgcgaaggccggctcgtggtcggcgtcggcgcgttcaccgcggacgccgcggaaatcgacgcgaacaccgtgcgtgccagccggctggtcgtcgacgatctcgccggcgcccgccacgaggccggcgacctgatcgtcgcgcgggtcgactggcagcaggtcgcgtcgctcgccgacgtgctgggcggcacattcgaccgcaccgggccgctgctgttcaagagcgtcggctgtgcggcgtgggatctggccgcgtgccgaaccgcgcgcgatgcgctggacgcgcgccgggccggctgatccggcagcacgacccgcctgccccacaggcggcacgtcacaccggggccgctccggcggtttcccgtacgcgttgtaggaatcgccctacaacgcgtcgccgcggcctacatcaacttccaattcggccgatttcattttcggcggcgcaacacgatactgccggcatgaatgccagccagttgcccgccgcgctccgggtgtttctcgtcgatcacgccgtcgccgtccgacagcggatcgcgctgctcgtcggcgcgatccgcggtgtcgccgtcgtgggcgaggcggaagacggccaggacgcgtggacgcacatccgcagcagccaggcggatgtcgtgatcgtcgacctgcggctggcggacggcagcggcctcgacctgatcgggacgctgtcgaaggccgcgccgcgcatcgtcacgatcgtgctgacgaatcactcggcgccggcattcagagaggcatgcgcgtcggctggagccgactacttcttcgacaagaccgtcgaattcgacgccgcatgccgcgtcatcgaatccctggtgcacgctcgcgtgcaccgcctctgacgagccggagtgactcatgtccacagccaccgcctgcgccgccgacgtatccatcacgccccggccgacgattccgcttcgcgcggtcacgcgtgccgacgccgccaagcatcccgccgcgcgctgctcggcgtgcgcgatgcgctcgatgtgcctgccgccgcaactgacggccgccgaatacggccgcctcgacgcgatcatctgcacgacccggcaggtgcgccagggcgacgcgctgttccgcaccgacgatccgttccagagcatctacgcggtgcgcgcgggttcgttcaagacggtgatgatgcatcgcgacggccgcgagcacgtgacgggcttccagattgccggtgaaacgctcgggatggacggcatcggcagcggccagcactgctgcgacgcgatcgcgctcgaagacagcgtcgtatgcatcatcccgttcggcgcgctcgaagcggcgtgccgcgagatcaagccgatgcagcacttcctctaccagatgctgagcagcgagatcgtccgcgaatcgagccagatgctgctgctcggcacgatgtcggccgaacagcgcgtcgcgcaattcctgctgaacctgtcgtcgcgcttcgaggcgcgcggctattcggcgacggaattcaacctgcggatgacgcgcgaggaaatcggctgctatctcgggatgaagctcgaaaccgtcagccggatgttctcgcggttccatcgcgaagcgctggtcgaaacgcgcggcaagcgcgtgcgcatcatcgactcgcaagcgctcgcccgggtctgaccgggcgcgccgacgcccggccgccggcgcggcatcgcgtgcgatgcctcattgcgccgcgctgcctgccgccgcatcgcgcagccccacccttgcaccgcgcgcctggcacgcgatcagcgcctgttcggcctgcatgaacgcgcggcgcagcgtgtcgtccatgtcgtcgccgacacacgccggcagcagccagagcgacgtgtcgcgcatcacgaggtcgagccgcacgtcgtaccggcgcgcgccatcggcggcggcacgcgattcgatggcgaggtggcagccgtcgatcagcgcgcggaagcgctcgagccgcaccagcagcgcgccggcttcggcttcgatcgcggcggtacccgcgaatccatggcaggcgatctgcatgcccacgcccatgtcgtgtctcctgacggggccgcccgctcgtcgaccgccttgcatatgccgcccgcatcgacatgcggcggcacgtgttgcccgtggcacggcgcgatttcttcgatcgctgcccggccgatagtctgcccgcgccttcgtcggcgcgggatcgttcatacgttgaaggtctgcgacgccttcatctcgatccatgtcatgcctgcccgcagcccttcgatcatcgcctcacgctcggtcggatacgcatggctgtgctcgaacgtatggtgaaagcgcgcggcgccggcgccatgctcgaccgacacgcggcagcggaattcgcccgattcgcacgggcgcgtctcgacttcgacggaccagtcgcgttcgtgaatgttgccctgcagtgtcatgcaccctcctgctgtatccgtctcagagccggaagtggccgctgtgcagcagcaccggccggccgccgatttcctcgagcatgcgtcgcgccatcgcctcgatcgccgaccggtgcgcttcgaatgcggccagcaggtcgcgttcgagcagcgacggcgcgccgaaatgatcctccagcgcctcggccgtgaccgcgcactgcacgcaacgtccgtcgaccagcgccgaaaacgccacgaccaggtcgcgtgcgcaatattcgggcggttccggcgggaaggcaatctgcatctgtccgcctgtcatcgtcgtgatggctccatgacaagagcatagtggcgcgcgcgcctccacgcttgacccacgtcaacgggttcgctgcgctgcacgatggacggcgcggcagcgtgccggccgcgactgcgcgacgccccctcgctcgctttcaacccgccttcaacccacgttcaacccgtgtcgggctcgatcgtcgcaccgcgttccgcgagcagttcgcgcagcacgctgcggtggcaatggcgttcgtcctcgcaatagcagccgatcgagaacgcggtggtcgccgacagcgccgccagcaggtcgagcaccttcggcgcgtcgccatgcgccatctccgcgcggaagtgacgccggaacgcgttccattcggcgtccgtttcggcggcctgcgcctgcgcgacgagttccgggctcggcgacaacgtcggcagccatacatcatagtagttgcgcgacgcgaattccgccttcggcacgccgcgcggcggccgccgcaccgtgccgatccgcaggccctcgccggcgcgcggcgtgccgagctggatgatccggatgcccatgtcgctccttttcgtgttgcgtccgattgcgtgatcgtaccgccgcgcctgcgcccccgtcagccgggtggcggacattgcggccgcacaaagaaaaaccggctgcccccttgcgggagacagccggttcggccagccgcgctgcgcgccggggcgcgccgcgatcagacgccgctcttcagcaccttgccgatcgcatcggcgacgatggcgacgttcgagtcgttcaggcccgcgacgcacatccggcccgaacgcaggatgtacacgccgtgcacttcgcgcagcgcgtcgacctgcgattcggtcaggcccgtgtacgtgaacatgccgcgctgcttcacgtagcgcgtcagtgcctcgccgctgacgtggtcgcgcaggccgtcatggatcgactggcgcatccgcgcgatgcggcggcacatcgccgccagttcctcttcccactgcttgcgcagtgccggcgtgccgagcacggtggctacgaccttcgcgccgtaggtctgcgggttgctgtagttcgagcgcacggcaccggccagctggccgagcacgcggtcggccgcggcggcatcctcgcagacgacgctcaggccgcccacgcgctcgccgtacagcgagaagttcttcgagaacgagttcgcgaccagcgccggcacgccgcggcgggccagttcgcgcaccgcgaacgcgtccgcgtcgaggcccgcgccgaagccctggtaggccatgtcgacgaacggcagcagcccgcgcgcctcgatcacgtcgatcagcttctcccactggccttcgtcgaggtcgacgccggtcgggttatggcagcacgcgtgcagcagcacgatgctgcgcgccggcagcgcgtcgatcgccgcgagcatcgcgtcgaacttcaggccgcccgtcgcctcgtcgtagtacggatacgtgttcaccgtgaagccggcgcgctcgaagatgaagcggtggttttcccagctcggatcgctgagccacacctgcgaatccgggaaatagcgcttcaggaaatcggcgcccaccttcagtgcgccggagccgccgagcgtctgcagcgtcgcgatgcggccggccgcgcgggccgggtgatcggcgccgaacacgagcgcctgcacggcgtcgcgatacgcggcgaggccgaccatcggcaggtacggcttcgcgccgaggtcgcgctgcagcgcggtttcggcttcgcgcacggcgcccatcaccggaatccggccttcggcgtcgaagtagatgccgatgctcaggttgaccttctggtcgcgcggatctttctggaagttctcgttgagcgtcaggatcgggtcgcccgggtacgcgtcgatgtgttcgaacatggcttgagtctgtctcgtttggaagaatgatcgggccggcctgcgtcagcgtgcggatgcgccgtcgtgcaccgcatagcctgcattcttctgacggaagcgatacccgaccgcgagcaccgcgagccataccgggatcaggtacaccgacaggcggagatccggcgtcaggtacatcacgacgagaatgccggccatgaatgccaggcacaggtaattcgtgaaaggatagcccagactgcggaaggaagtctcctcccgggccgcacgcttcgcctggcggaacttcaggtggatcagcgtgatcatcgcccagttgatgatcagtgccgacacgacgaggcccatcagcacctcgaacgccttgcccggcatgaagtagttgaccagcacgcacacgccggtcgcgagcgccgacgcgccgagcgcggcgagcggaatgccgcgcctgttcaccgagcacagcaccttcggcgcattgccctgctgcgcgaggccgaacagcatccggctgttgctgtacacgccgctgttgtagaccgacagcgcggccgtcagcacgaccacgttcagcacgttggccaccaggttgctgctcagcgcgtggaagatcagcacgaacgggctgccgccggtgacgaccttttcccacggatacagcgacagcagcacggcgagcgcgccgatgtagaaaatcaggatccggtagatcacctggttggtcgcgcgcggaatgctgcgcttcggatcgtcggcctcggccgcggtgatgccgatcaactccagcccgccgaacgagaacatgatggcggccatcgacatcacgagccccgacacgccgttcgggaagaagccgccgtgctgccacaggttccggacgctcgcctccgggcctgcatggccgctcgcgagcagccagccgccgaagccgatcatgccgacgatcgcggcgaccttgatgatcgagaaccagaattccgtctcgccgtacgacttcacgctcgccaggttgagcaggttgatcgcgacgaagaacaccagcgccgacacccaggtcggcacgccgggccaccagtactgcacgtagatcccgacggccgacagctcggccatgctgacgaggatgtacagcacccagtagttccagcccgacaggaagccggtgaagtggccgacgtacttgttggcgaagtagctgaacgagccggcgacgggctcgtcgacgaccatctcgccgagctggcgcatgatgaagaacgcgacgatgccggccaccgcgtaaccgagcagcacggacgggcccgccatcttgatcgtctgcgcgataccgaggaacagcccgtgccgagcgcgccgccgagcgcaatcagctggatgtgccggttcttcagcccgcgcttcaggccgtcgctctcgtttccagaaaccatgtcttctccactctgtccgcctccgcctgaagcggggtgcggtgcgcctcggtgtgccgggcgctgttttgctgtgccggggccgttcgtggagccgccgggttggggactgcaatcttcgcgtggcggcgcccgattcgcgtcggcgtccccgccagaccggccgccgaccgtcgccgctcccgccttgctgcgatcgcacacgaaaatccggcgtcagtttagcgtcgcgacggcgaaatcgggtttcgtaacccgttcatgcaaaccctacattatgagataagattgcacccaggagacggatgaggaaataaaaatgcatgaaccggttctggatcgcctcgatcgccacttgctcgcgatcctgcaggagaacggccgcgcgtcgaacctcgacctggcgaaggcggtcggcctgtcgcccgcgcagacactgcgccgccaccggcggctggaggagatcggcgcgatccgccgctacgaaacccggctgtgccccgatacgctcggttttggcgtcaccgccttcgtgcacgtgacgatggagcgcgggcatatccgcgacctgtcgaagttccagaaactggtgtcggatctcgcgcagatccaggagtgtttttcagtgacgggcgatatcgactacgtgctgaaggtcgtcgcgcgcgacctgaaggggctgtccacgttcctgctcgagacgctgatgcgcattcccggcgtgagcggcgtgcattcgagcgtgtgcctcgacgagatcaagtgcacgagcgcgatgccggtggaagggtgaagcaccggcccgcttacctcaccgcctcgaacgcactgatcagcaacgcccccgccgcgatcaccacgcatcccgccgcccggcgcggcgtcagacgctcgccgagatacacgcgtgcgatcagcgccgcgaacaccacgctcgtttcccgcagcgccgacaccggccccatcggcgcgcgatccatcgcccagatcacgatgccgtacgcgagcgccgcgaacacgccgccgcacgcggccttcgccgtttcgccgacatcctgcgtcagccgtaacggccccgcccgcagccggtagtacgcggccatcatcgcgcccgtcagcacgaacatccacgcggtatagccgaccgtgttgccgctttcccgcacgccgattccgtcgaccacgctgtaggccgcgatcgacacgccggtcgcgaacgcggtcggcaggacctgcatcatccggtgcttcgcgtcgcgcccgcgctccaggccgatcgccaggatgcccgcgcagatcagcacgagcccgcattgcgcgccggcattcaggtgctcgcccgcaaacaccgccgcgccgagcgtgacgagcagcggcgcggtgccgcgcgcgaccgggtatgcgacagtcaggtcgccgtgctcgtacgcacgcaccagcagcagcgtatagacgacgtggagcacggccgatgcgacgacgcagagccagctcgcgggcgtgatcggcgccgcggccggcaggaacagcagcgcgaacaacccgatggcgatctgcagcacggtggccgaccgcagccggtcgccgctgctgcgcacgagcgcgttccatgacgcatgcaggaacgcggcacacagaacggcaaacagaacggggatcggcacgatgcgtactcgctgacggtcggccacgcgaaatcgtcgccgcagggcgttcatcgtatgaatacgtcatccggttgtcaaaaacctgctccgcgcagcgtcctgcgcccccgcgccgccatgccgtttcgcctgtcccgcccgccccgtggggcatccacggcaatcgccccgcccgccgcggaatgtgacgcaaaggtggcaggcggtctgccctttccgttctctttcggttcgcgtcccggcgtaatgaaatcgataccgcagcgcaatcggcgcgaaaccactccgtccccatatcttcatacgggactgttccaatgcgcgtgctctctcacgagctccgcgccgaaccgacacggcgacggggccgctctccaccatcgaagaccttacctggagtttcccgatgttccgtcaagccttgctcgtcaccgcctgcgcagccgcggcgctggcgctgttcgcctgcggcggcagcgacgatcccacgtcgacgcctgccgtgtcgtcgcaggatgcgctgcagaccgccacgccgatcaagcatgtcgtcgtgatctatggcgaaaacatctcgttcgaccactacttcggcacctacccgaacgcgacgaacccgtcgggcgaaccggcgttcaccgcgaaggccggcacgccgacgccgaacgggctgacgggcacgctgctcaccgcgaacccgaacttcacgaacacggccaacggcaccgacgcggcgaacccgttccgcctcgaccgcacgcaggccgcgaccgccgaccagaaccacgcgtacacggccgaacagcaggccgaggacaacggcctcgccgacctgttcccgaaatacaccggcaagggctcgtccggcggcgccggcgcattcggcacgaagggccaggtgatgggctacttcgacggcaacaccgtgaccgcgctgtggaattacgcccagcgcttcgcgatgagcgacaacacgttcacgacggtctacggcccgtcgacgcccggcgcgctgaacgtcgtgtccggccagaccaacgggatgcagatcgtcaagacgtcgaagcagccttcgacgctcgcgtccagctcgtactacatcaatgacggcgcgggcggcctcacgatgatcaacgacgtcgacccgggcttcgacgtgtgctcgagcacgaccgaccaggcgatgatgacgggcaagaacatcggcgacctgctgaacggcgcgaagatcacgtggggcggcttcatgggcggcttcaacctgtcgacgacgaacggcaacggcacgacggctgcgcgcgcagtacggtcgcgaccgccgtgaacgccgcgacggccgactacatcccgcaccacaactggttccagtactacgcgtcgaccgcgaacccgcagcacacgcgcccgagctcggtcgcggcgatcggctcgagcttccagaccgacggcaagaccgccgaacccgcgaaccaccagtacgacacggacgacttcttcgccgccgtgaaggccggcaacttcccgtcggtcagctacctgaaggccccggccgcacaggatgcgcacgcaggctattcggatccgctcgacgagcaggcgttcgtgacgaaggtcgtcaacttcctgcagcagcagccggactggcagaacacggccgtgatcgtcacctatgacgactcggacggctggtacgaccacgtgtatcggcaccgacgcgcgcgtcgtccgatccggtcgaccaggtcaacggcaacggcaagtgcggcacgggcggcaccaccggcgtgaacggcgcgaccgtgaacggccgctgcggcccgggcgtgcgcattccgctgatcgtgatctcgccgtacgcaaagcagaactacgtcgaccacacgatgctcgaccagtcgtccgtcgtgcgcttcatcgaggacaactggctgggcggccagcgcatcggcggcggttcgttcgatgcgacggcgggcgacctgcgcgcgctgttcgacttcacgtcgaagccgaacacgacgccgctgtacctcgacccgacgctcggcaccgcattgagcgcggcaccggcgatctgaccggtattgcatgaccgcatggccggcgcctcacgcgccggccgtttccgtttgttccgttcaacgcgccgcttcgtgcggcgcccgatttccgaccgacagcatgacagctcgccccgcgttcccgtctcccgacgcctccggcaccgccgcgccgcgcgccccttcccgccttctgcgccgcgcggcattcgcgatcggcgccgccgtgctcggctacggcgcgttcgcgatcgcgtttcccgcgcaggtaccggcggcgatcggcaccgtcgtcgccgactggacgggtgcgaacccgcatccggtcgtgctgcagcgccgcgcagccgctgtcggcggtcgcgcagctcgggcgcgcgctgttcgtcgacccgtcgctgtccgcgtcgggcaagcagtcgtgcgcgtcgtgccacagccccgatcacgcgtacggcccgccgaacgcactcgacgtgcagccgggcggcctcgcgatgacgcagcagggttaccgcccgccgccttcgttgatgtacctgtaccgccagccgaacttcagcatcggccccgacgccggtgaaaacgacgccgcaccgagcgtcgcgcagcaggccgcttcggccgccggcgtggtgaaggcgcagaaggtggccggcacgtcggccgcgccgcaactcgtgccgcagggcgggatgttctgggatggccgcgccgatacgctgcagcagcaggcgttcggcccgctgctgaatccggtcgagatggcgaacgcgagcatcgacgacgtcgcgcgcaagctcgcgcagtcgtcgcaccgcgcgcagttcgagaaactgttcggcgcacgcgtgttcgacagcccgcagctcgcggtatcggaagcgatgttcgcgatcgcgcgctaccaggtggaggatccgtcgttccacccgtacaacagcaagtacgaccgctggctcgaaggccgtgctcggctgactcgtgccgaactgcgggggctacgcctgttcaacaacccggacaaggcgaattgcgcgggctgccacctgtcgaagcccggcaaggatggattgccgccgatgtttaccgactaccagtacgaggcgctcggtgtgccgcgcaaccagcagctcgcgcagaaccgcaacccggcgttccacgatctcggcgtgtgcgggccgttccgcgacgacctgaaggaccagacgcagtattgcgggatgttcctcacgccgacgctgcgcaactcggcgacgcgccatgtgttcttccacaacggcgtgttccacacgctcgaccaggtgatggcgttctacaacgagcgcagcatctcgccgcagaagttctattcgcgcggcgcggacggcaaggtcgacgagtacgacgacattccgccgaaataccgcgcgaacgtcgacgtgaccgatgcgccgttcgatcgcaagccgggcgacaagcctgcgatgacggcgcaggacatcagggatatcgaagcgtttctgggaacgttgaacgacgagccggcgcgctgacaggccggcggtcggttgccgtgcgcgccgtgttcgtcagcggcgcgcccggatgcacaggaaggccggcgccagtgacagctccgcatggagccgctccgatacggccttcatttcgggtagcggtgtcggttcgacgaaacggtcgagacgccagccggcgtcggcgagcgcattcaggatgtcggcgagcggccggcgccaggcctcgacgtagggtttcggttcgccgaagcccgaccaatggaagccgaaacggctcgtatcgaagtacgtgccgtccccgcgcgtgcgctcgtccatccagtcgcgcatcggatgcgccatcgagaacaccagcgtcgcgcccggccgcgcgacgcgtctgaattcgcgcagcgtcggcgtcaggtcgcgcacgtagtcgaacgcgagcgagcacaggatcttgtcgaaagcgtgatcgggcagccagtcgagcggcgccccgagatcgccttccgcgacgtcgaccgcgagccccgcgcaacgcgccttcgcgagcgcgaccatctcgggcgtgatgtcgaacgcgtggacggtcgcaccgtggcgcgcgaggtgctcgctgcagatgccgggcccgcagccggcgtcgagcaccgtcaggccgtcgacgtcgccgagcagcgccatcgtagccggccgctcgtaaagcgcgttgtgtgccttggtcggcgcgatgtccgcgtagcgttgcgcgaagctcgcgtaaacgcggcgggcggacggttcgttcgggtcggtcatgcggcatccgtcggtggagactgggcaggccgattctgcccgatccgacggcggctggcgacctgccctcgcgccggcgtcaggacaggctgtcgagcaaccgataccacgcgaccccggccgcgatatagaagcgctgcaacccgtgcaacgggatcgggcggatcggcgtgacccggaacggcagcggcagttgcacatcgcccgacaggtgcgcggccaggtgcttgccgagcgtcgtcgccatcgcgatgccgcgcccgttgtagccgagcgcgatcgtcacgcccggcgcgggctcgtgcacgtgcggcaggaaatccgcggtgatcgcgacgcgccccgcccagcggtattcgaaccggacgcccttcagttgcggatacagcagcgtcgtcgcgcgttcgaggtgacgccagtcgctcggcgcgcgcgggtcggcgaacgggccgcggccgcccatcagcaggcgcccggccgcgtcacggcggaagtacagcagcagacgccgtgcgtccgatgcgacctcaccgccagcgaggatgtcgcgaccgagttccggcgcgagcggttccgtcgcgacgatgaaactgttcgcggcgatcaccgactggcgcaagccgggccacagcccgtccgtgtagccgttggtcgcgatcacgacgcgttcggccgacagcgtcgcgccgccggacgtcgcgatccgccagcggccgtcggcgcgcgtcagcccgacggcgcgggtcgccccatgcacgaccgccccgctcgcctgcgcggcgcgcacgaggccgcgcgtataaccgagcggctgcacgctgccggcgcggcaatcgatccagccgcccgcatacgctggcgtgccgagccgacgcgcgacttcgtcgcggccaagcacgtcgaccggcgcgccgcgcgcggcccattgctgcgcccgacgtgcgaccgtgtcgagcatcgcggcggtcggcgccggctggatccagccggcgcgacgcgcatcgcagtcgattccgtaccgcgcgatcaggtcgaacaccgtgtcggccgcgccgccgacgatgccggcaagctgttcgccggcctcgtcgccgaaccggcgtaccagttcgtcggggtcgtatttcagcccgggaatcacctgcccgccgttgcggcccgatgcgccccagcccggctgcgcgccgtcgatcacgcggacgtcgacgccgcgttcggccagatgaagtgcggtcgacaggcccgtgaagcccgcgccgacgatcgccacgtcgcacgacacggacgcgtcgagcgcgggcgtatcgggcgccggcgcggcggttgccgcccacagcgaatccggccactgcgcgtcgggccgtccgggtgccgcgttcgttgcgctcatgttcgatccgggtggtcggcgccgtccgacgccagcaggcggcgcaggaattcctgcgtgcggggatgggtcggctgcgtgagcacatcgcgcgccggtccgctttcgcagatcgtgccgtcgtgcaggaagcacacgcgatcggccacctcgcgcgcgaatgccatttcgtgcgtgacgaccaccatggtcatcccgtcgcgggcgagcccgcgcatcacgccgagcacttcgccgacgagctcggggtcgagcgccgacgtcggctcgtcgaacaggatcgcctgcggcgccatcgcgagcgcgcgtgcgatcgcgacgcgctgctgctggccgcccgacagttccgacggatacgcgttcatccggtgcgaaagcccgaccttgtcgagcagcgcacgcgcctgctcgcgtgcctgcgcggccggcatgcgccgcacgtgcacgggcccttccatcacgttctcgagcgccgtgcggtgcgcgaacaggttgaagcgctggaacaccatgccgacccgcatccgcagttcgtggatccgcttcgaatgcgcgtcgaccttcacgccgtcgatcgtgatcgacccttcgtcgtaggtctcgaagccgttgatacagcgcagcacggtcgacttgccggaaccggacggcccgatcaggcacacgacttcacccgcctgcacgtcgaggctcacgcccttcagcaccgcgtgctgatgaaaccgtttatgaatggaatcgatccggatcatgcgcccctcctcagtgcgagccgcttgccgagccggttcacgccgaacatcagcggcaggccgagcgcgagatacagcagcgcgacgagcgtatagacgctcatgttctggaacgtcgacgacgcgatcagctggccggcgcgcgtgatctcggcgaccgtgatcgtcgacgcgaccgacgaatccttcagcaacatcaccagcgtgttgccgtacggcggcagcgcgatgcggaacgcctgcggcagcaccacgcgccgcatgatcatcggcccgcgcatgccgatcgcgtgcgcggcctcgatctggccgcggtcgatcgcctcgatgcccgcgcggaagttctcggcctgatacgccgaatacgcgatgccgagaccgagcacgccagcctggaatgccgacagttgcacgccgagatcaggcagcacgaagtacatgtaaaacagctgcacgatgatcggcagcccgcggatcacgttgacgatcgtgctgccggccgtcgagacggcacgattgcgcgacaccttcagcagcgcaaggatcagcccgagcaccgagctgagcacgaacgcgcatgcggtgatctcgatcgtgaccaccgcgcccttcagcaggatcggcaggaaatcgatcgcattctggaaaaacatgaggcctcctatgcgacggccggacggcccgccgccgggaatgcccgcgacgcgcgggcgatgccggtcgggaatcgaatgccgacgctcagctcatgtgccacttctgcaggatctgctgcagcgtgccatcgctcttcatcttgcggatcgcaccgttgagctgttcgagcgtcgcagtgtcacccttgcgcacgatgaagcacacctgccccttcacgacgctctggtattccggcacgagccgcacctggcgattgacgccgtgttcgatctggtacgcgacgatcggctggtcagcgaagccggccttgatgcgcccgagcgcgacgtcgcgcatgatgtcggcgatcgaatcgtaggtccggacttccttgaagatgcccttcttgttgagcgcatcgacgaacgccgtgccgacctgcgcgccgaccacctggtccttgaaatcgtccatcgacgtatagcggcccgggtcgtcggccttcacgatcaggccttcgccgaatgagtagacggtgtcggaaaaatcgacgacctgctggcgcgccggcgtcttcagcatcgcggccgagatgacgtcgatcttctgcgtggtgagcgacgggatcagcgccgagaacacggtctgctgcacgtcgacgcgaaacccggccgacttcccggctgccgtgatcgcatcgaccatcatcccctggatcgaattgctcttgacgtcgagaaacgtgaacggcacgccggtggccgtcgcgccgaccttcagcgtcggctcggccgcaacggcacccgccgacgccgtggacagggcaatacaggtggcgaaaccggcggccagtgcgccgaaccgcttgatgaacggaaccatggtgactccttctcgaataatccgggcgccggccggtcgctgatcgacactgcgacgatggcccgatcttaaaacgaatcaaaaacatcgcaaatagatttttgcgtatcgatattcgatacgctatgatgcgatatcgaatcgattccgctcctcgccatggaaacgtcgcccgaccaagcaaacgatctgctgttcaaccagtcgctggaaaaagggctgaacgtgctgcgcgcgttcagcgcgaaacggcgcacgatgacgctggcggaggtggccgacgcggcggggatgacgaaaagctccgcgcagcggatggtctatacgctcgagaagctcggctacatccgcaagcatccggtcacgcggcgttaccagctcacgccgcacgtgatgcggatcggcttcaactatctcgccgccgacacgttgatcgacgtcgcgaatccgttcctctccgagctcacgaacctgaccggcgaaaccaccaacctcaccgagccggacgaggacgaaatggtgtacgtcgcgcgtttcgtgtcgaccaagttcgtgccgattcacatgccgatcggcagccgcatcccgatgtactgcaccggcagcggccgcgcgttcctgagcgcgctgccgccggacgacgcacgcgcgcggctcgacggcatggcgcgcacgccgcatacgccgcgcacggtcacggcgctcgacgatctcgtcgcgctgctcgacagcgcgcggcgggaaggctacgcgaccaaccaggaagaactgttcatcggggacatgtcgatcgcggcacccgtggtcggcagccaggggcagccggtcgcggccgtgcacgtggtcgcgccgacgagccgctggacgttcgacgacgcgcgccgcaagctcgcgccggcggtgatcgactgcgcgcgcgggatcagcaattcgatccggacgctcgagtagggttcgtgaggcgggagaccgtgcgccccggcggtgcgcaacggcgtttgatcgctactgcggcttccgcgaagcctcgctccgataagtccggttcggatgcaacacgagcggcttcgcgacagcgtccagttccttgccgtgatacagatcgaggcacttcaggaagtcgaacttcacgtccccgacttccgattcgacaaccggattccgatagtctcgcgccagatacttcgcgaccagcgcgtgaatgacatccggcgcacgctccatgtcgtagtgggtccagtcgcgcaacgcgccgatgctgctgccgatgtccttgctcacgccggcctcctgctcgtaagcggtagccaggcactccgcgagcaccctgtctttgaagttctggaggtaagtccgtgagccggcctcgggcgatgtttgtgcgccgtccttcgccacgaccatcgcgggttgaaacgcaatgcacgccaacacggcagcgatccggactcccctcatgacaggctccaaaagtttgcgcgatcggaacgataccgcgcgcccggttcgttgaagtaaccatggtcgcgccccggatgctcgcgtccgtcgccctccgcggccggacctcgaggatcggatcaaaccccgacggggaaaagtatggccgactgtcgccgacagcctcttcgtccacccacccctcgttttccccgatcccgttcatcttgactccgccgcaccgatcgacaaaacttcgcacatcgcaagtgtgatcacagatcgcagatcaatcccaggagcccccttgccgcctcgtatcgtcccgcccgcactgaaagccatcgaacaggaaacgatggccgacaaggtctaccagcagctgcgcgaagcactgatgagcggccgcttcgcgcccggccaggcgctgagcctgcgcagcgtcgccgaggcagtcggctcgtcgacgatgccggtgcgtgccgcgctcacgcggttgcgcgccgagcgcgcgctggtcgacggcccgaaccgggcgctcgtcgttccgccgatgacgctcgacatgctcgacgaactgcgcgacgtgcggatcgccctcgaaggctgcatcgccgagcgcgcgtgcgagcggatgaccgacgcgcagatcgcggtcgtgcgcaagacctgcgaaacgatgcaggcacacgtcgaggccggccgctcgcgcgcctacttgcaaagcaatttcgcgttccacagcgcgatctacgcgcacggcgccagcgaaaacacgctcgcgatcgtcgagaacctgtggatgcgcgtcggcccgttcctcaacatggtcgcgctcgacattccgcacatgcggcgctcgatggatgcgcaccgtgccatcgtcgatgcactcgagcgacgcgacggcgcgggcgtgcgggccggcatcgcgctcgacatcggcggcgccgcgcacgatctcgccgagacgctgcgggccgaacagacactgcggaccgtgaacgcgaaaccgtagccgccgcccgcctcgacccgccgaatcgcgagcggccgcaatccgactacaccaacgatggagacaacccggcatgacagcttccgacctgctgaaaccctatgacggcctgcgcgtcctcgtgacgggcggcgcgtcgggcatcggtctcgaaatcgccgacgcgttcgccgaatgcggcgcgcgcgtgcacgtgtgcgacgcctcgcaagccgcgatcgcggcgctcgccgaccggccgccgcgcgccgcggccggcgcgatcagcgcgacgctggccgatgtatccgacccggccgccgtcgagcgcgtgttcgccgacgtgtcgaccgggctcggcggcctcgacgtgctggtcaacaacgcggggatcgccggcccgaccggcggcatcgacgaaatcgaccccgtgcagtgggaacaaaccgtcgcgatcaacctgaacgcgcaattccagttcgcgcgccgcgcggtgccgctgctgcgcgagtcgaaacacggcggcgcgatcattgcactgtcgtcggtcgccggccggctcggctatgcgttccgcacgccgtatgcggccaccaaatgggcggtggtcggcctcgtgaagagcctcgcgatcgaactcgggccgctcggcatccgcgtgaacgcgatccagcccggcatcgtgcgcggcccgcggatgcgccgcgtgatcgaggcgcgcgcagcagctcggcatcggctacgacgacatggagaagcgctatctcgagaagatctcgctgcggcgcatgaccgatccggccgagatcgccgcgaccgcgctgttcctgtgctcgccgggcgggcatggcatcaccgggcaggcgatctccgtctgcggcaacgtggaagtgctctgacgcgtcctgcatcgttcatcgaaaggaatccatccgtggcaaacgctcgcaaagtcatcatcacctgtgcgccgaccggcgcgatccatacgccgtcgatgtcgccgtacctgcctgtcacgccgcacgaaatcgaaacggccgcggttgcggccgcacgggccggcgcggcgatcctgcacctgcacgctcgcaacccgtccgacggcaagccgacacaggatccggccgtgttcgccgaattcctgcctcgcatcaaggcgcagaccgacgcggtgatcaacctcacgtcgggcggcagcccgcacatgacggtcgacgaacggctgcagcccgcgctgcatttccagcccgaggtcgcgtcgttgaacatgggctcgatgaacttcgggctgtacccgatgctcgagcgcttccgcgagctgaagcatccgtgggagcgcgaacatctcgagaaaagccgcgatctcgtgttcaagaatacgttcgcggacatcgagacgatcctcacgcgctgcggcgcgaacggcacgcggttcgaattcgagtgctacgacatctcgcatctgtacaacctcgcgcacttcgtcgatcgcgggctcgcgaaaccgccgttcttcgtgcaaagcgtgttcggcctgctcggcgggatcggcgcgcacccggaagacctgatgcacatgcgccggacggccgaccgcctgttcggcagcgattacgtgtggtcgatcctcggcgcgggccgcaaccagattccgctcgcgacgatcggcgccgcgcaaggcgcgaacgtgcgcgtcgggctcgaggattcgctgtggatcgcgcccggcaagctcgcggaatcgagcgccgcgcaagtcctgaaaatgcgtcaagttctcgaaggcctgtcgctcgagatcgcaacgccggccgaggcgcgcgcgatgctcgcgctcaagggcggcgacgccgtgaatttctgatcgccgggtcgcccccgacacccgcatccgcaagcgcagtgacaaggcgccggcccgaaccggccggcgccaggacgcccttcatcgccccgctccgttcgagcgccgccggcgcggctccgtcgactgcccatccgctgtctgccgcgcagcggcatttgccgaacgcggcgcgccgtgcttgccgtgcgcgccggttcgcccttaccggagtcgtccgcatgtccactcatcacgctcaggccctgtcgtccaccgcgaccgacgcgaacgcgtcgctgaaccggctgctgttccgcaaactcatgccgctgctgattgccgcgtatgtgatcagctttctcgaccgcaccaacatcgcgttcgccaaacattcgatgggtgtcgatctcggcatctcgtcggccgcgtacgggctcggcgcggggctgttctttctcacctacgcgctcttcgagatcccgagcaacctgatcatgcatcgcgtcggcgcgcgcttctggatcacgcggatcatgatcacgtggggcgcgctgtcgatcgcgatggcgttcgtccgcggcgagacatcgttctacgtgatgcgcctgctgctcggcgtggccgaagccggcctgtttcccggcgtgatgctgtatctgacgtactggttcggccgggaggaacgcgcgcgcgccaccggctatttcctgctcggcgtgtgcattgcgaatatcgtcggcgggccgctggccggtgcgctgatcgaactcgacggcacgctcggtttccacggctggcaatggttgttcgtcgtcgaaggcattccggcgatcctgctcgcgttcgtcgtgtggacacggttgccggaccgtccgagcgccgcgccgtggctcgccccggaaaccggccgcgcgctcgagcgcaatctggccgccgaacaggatgctggcgtcgccgcgcacggcggccacgcgttcggcgccgcattgcgcgacccgcagatctggctcgcgatcttcgtgtacttctgccaccagttgaccatctacacggtgatcttcttcctgccggggatcatcggcgcgtcgggacgtctgtcgccgatcgcggtcgggttgctgacgtcgctgccctggctcgccgccgcgctcggggccgggacgttgccgcgcttcgcacgcgagtcgcgtcattcgcggcggatgctgtgcgcggggctcgcgatcatggccgccgggatggtcggtgccgcgcatgcgtcaccgttggcgggcctgctctgcgtgtgcgtgtccgcgtcgatgttcttcgtcgtgcagtcgatcgtgttcacgtttcctgcgtcgcggctcgccggcagtgcgctggccggcgggctcgggctcgtgaatacatgcgggttgctcggcggcttcgtcgggcccaccgtcgtcggcgcgatcgaacaggcgaccggcaatgcaaagaacgggctgacgctgctggcggccgcgctcgtcgtcgcggcattcgcgagcctcgcgttgcgtcacgggcacgagcgcgccgacatgcggtcgcgcggctgaaaggcaggctggaaccagaccggcgtgagacgggctgcgccccgcccgcctcacgcggtcagaacagatacatccccgcgacgaacacgacgcccgagaacagcagcgtcgtcacgcagtaccccatgatgtcgcgcaccccgagcccggcaatcgccagcgcgggcagcgcccagaacggctgcgccatgttggtccaggcctcgccgtacgcgatcgccatcgccgccttgccgagatcggcaccgagcgcctgagccgccggcatcacgaacgggccctgcacgacccagtggccgccgcccgacggcaccgcgaaattgatcacggcggaactcaggaacgcgagcagcgggaacgtatgcacgttcgcgatatcgacgaaccacttcgtgatcacgcccgcgagccccgaatgatccatcagcgcctggatgcccgcgtagaacgggaactggatcatgatccccgacgcgccgcgcgccgcaccggccaccgcgcgcgcataggccatcggcgtacggtgcagcaggatgccggccgcgaggaacgcgaggttcacggtgtcgatgtcgagtgcgaagcccttctgcacgaacttcagcacgaggaacgccgcacacagcgccgcgacgaacaccgacaacgcacggctctcctccatccgctccgcgaacgtcgcgtcgggcccgagctggcgctcgacgctcggcggttcggccagcaacgccggatcgacgctgaccacgtcgcccggcttcggcatcatcaggcgcgcgaggaacggcagcatcacgatcaggccgatcgtgatgaacgcgttgtagccggtgaagatcgtctgcgacacgggaatcagcccgatggtcctttccatcgggttgcctttcgtggccgcgacgagcgggaccgaacccgacaatccgccgtgccagctcaggaagcccatgtacgcggacgcgacgagcagccggtaatcgctgccggccacgcgacgcgccacttcgcgcgcgagcatcgcgccgagcacgaggccgaagccccagttgatcgcgcacgcgagcgcgccgacgaacgcgacgagcatcacgccctgccccggcgtgcgcgcggtgctcgcgagcgcgacgagcatgcgcttcacgggcggcgaactcgcgagtgcgtgaccggtgacgagaatcatcaccatctgcatcgagaacgcgagcaggttccagaaacccgaaccccacatcgtcgtgagttgggcgggcgtattgggtgtgaggccgaacgcgagcgcgaacgtgacgatcgtcagcaggatcgcgaaaatcaacgggtcgggcaacacgcggtgaaccacctgcgtgaaaaagcgggaaatgcgctggatcaacttgagctcctcgtttcctgatagggacgtccgcgcgtgtcgttgtgggtggatgcgcggaaacgcgcggattcttgcatagaaccggcggacgcgctttggtatgcgcggggccgcgatcgcgcggtcgtatcgacaggaaaacggggataaatgacaggcagcccttacgtcgcttcgcagcctcgatcaacgcaccgcgttcgtcacgcctcccagcgcccgcgctccatcgcctcgaccatcatgccgagtgtgagcgaccggccgcccaggatttcgcgcgccttgttgctgaacggcgatctgacgaccgtggcaaggaacgaaccgatgccgagcttcgccgacgggtagtaatcgtggatgtcgaacatggacaagtcgacgtcaaacgtcacggcccatcgccggacgaacgcatcgatgtgctccggctccatgtcgagatcgtgatagagatccgtgtcccgcgtgagctcgatccgaccgactggcagcttgccgatatcggtcgcaatgaacgcttcgaggtttttccaggcgtcagccatacaaacgatcctcgggcttcacgatgctgttgtacgtgccgatcgtgcgataagtgatcagcgagatatccgttgccaggaggacccaacctgctcctggaatggcgcgcccgacaaaagcgccgatattccgcgtgaacttgatccgcaacatgacaagactcgtgaacgacgtaacggttggcaaaatccgatgcttcagttcgtacggcagcaagcgacgagaaaccaccgacgcgatcgaggtgcccttgacggcgtttgcgaacttgccgcgcgtgcggataaagcgctggcccagcaacaccatcgcgataccgatcgcgtcatctacacccgccgccttgccagtctcttcgatgaagatcaggaaaagcaacgcttcgcggctcaagccgtcatgaacgccgtacttgtacgaattcgacattttcctcagatcgtttgaatttgaatgagcggaaaacgctatcgtgaatgactcgggaaggacaacggacccagggaagcaatgactgttgcacgcgtgcatccgggcgcaggtgatcgacgggatgccgttcctctaaagcggccccacgcttggcgcctccgatcgtatcggcttcatcgtcctgcgtggatcaccgcggcaacagcttgctttggaacggatacaaatcgtcaactttcggtgatttgtttgcgacaaaaaggcaaacgtcgttcgcctcctggctgcatgtgcgcattaacgcatcgccaccgcacgctcgttgaccacctccatcgccttcgcccgcccctcgctccaccgttgcgccacccgatacgcgacgagcgacccggtcacggcaagcagcatcggcacgagactgtcgtgatccgcgcgcgtgaactcgagcagcagcacgaccgccgtgatcggcatctgcatcgacgcggcgagaaacgcggtcgcgccgacgagcgcgcaagcgccgatcgacgcacccggccacacgaggctccacagcccgccgagcacgacgccgagcagcgcaccgttcgcgaggcccggtgtcagcaggccgccttccgcgccggcccgcaggctgccggcctcgatcagcaccttcagcacgagcagcgcggcggcgaggccgatcgtcagcgtgccgtcgaaacccagcgacgccgggcccttgccgttgccgagcagttgcggaaaccgcatcgcgagcacgccgatcaccgcgaagttgatcagcgcgagcacgggcagccgcccgtctttcggcgcgttcgcccgggcgcgcgtcgtgagccgcacgaagccgtatgcggcgaagccgaacagcggcccgcagacgatcgaccatgccaccagcggcgtgctcagcacgaacggcggcaccgtgtactggtgttcgttgccgaggccgatccacgcgacggccgcggcgatcgccgacgtcgcgaccgccacgaccagcgcacgcagttcgaacgtgccgagcagcacctcgagcacgaagatcgcgccgccgagcggcacgttatagacggccgcgaggcccgcgcccgcaccgcacgcgaccatcagccggcaatcgtcggggtgagccccgcacgatgcgcaagctgccccgccagcagcgatccgatctcgcgcggggcgacttcgcggccgagcggcgagccgagcgcgacggtgacgatctgcagcagcgcgtgaatcgtcgtgctgacgaccggcatccgcggatcggccgcgcgcaccgcgcggcggatgctgacgagcggccggccataccggtacagcgcccaccagccgccgccggcgacgatcccgcagacgatcagcaccgcgagccggcgcagcggatcggcgccggtcacgccggtgaggaagctctcggtgccgatcacgtgcgcgacgctgtagccgaacgcgacgtgctggatcgcatgcagcagcagcgcgagcagcatgccgccgaggcccgcgccgacgccggtcaggatcgtgacgacggccatgcgcgcgaacgggctggcggccggcgaaagggatgcgggagcggacgggagatcggggcgcatggggttcgcgaatgggatcgaaaaagacggcgcgccactcgcgccgtcgtcaggaccgcatcgtaggccggcgacaatcatgagacaaacgtatttttcgaatcgactcatgcattcgatgaatacccgaagagcggcgggtcaaggcagcccgaagttcaccgtccgcttcaatccggataccggatacgtgatgcgttccggttcacgccgcaggatcgccttcccgttgcggcgtattcgtgaaaacggccgcgtgcttcgagtcggcaggtcgcgcgatccggttgacgagcctggaatgcgtgcacgcgcccgcccttgaacgcgggtgatgccggtcgcgggcgcagacgcaggcgagccgttctccgcgcgccagtcgcaccgacccaccgccgcgccacgccccgctcatgttgcaccgacgcgacagcacgcccgcgacggacacataccgcccgcgtgcgaccgtgcaaaaaccaccaccgtcacgcgcgcaccgcgcgtcgtgtcagttttgtgaacgactcttgcctgatccggaaaggtgcgctcgcggccccggcggccttgcgcgcgggttgcgttcctatacttgcgccgaactttcgttccccttccacacgcaggagcctcacttgaaaaaccctcgtcgccggcgcatgcaccgccacgctgttcgccccgctcgctcacgcacagagctcggtcacgctgtacggcctgatcgatgccggcatcgtctacaccaacaacgccaacggcgcgtcgctgtggcgcctgaacagcggcaccgtcaacggcagccgcgtcgggtttcgcggcaccgaggatctcggcggcggcctgaaggcgctgttcgtgctcgagaacggcttcaacgtgaacaacggcgggctcgggcaggacggcaagctgttcggccgccacgcgtacgtcggcctgagccagagcggctatggcacgctgacgctcggccgccagtacgacacgatggtcgatttcgtcgcgccgctgtccgccacggccggcgacctcggcgacacgagcttcgcgcacccgttcgacaacgacaacctgaaccactcgctgcgcatcaacaacgcggtcaagtacacgagcgagacgtatgcgggcttcaaggtcggcgcgatgtacgcattctcgaacgcgaccagcttcggcgcgaaccgcgcatacagcgtcgcggcgagctacacgaacggcccgctgaagctggccggcgcgtacctgcagatgaacggcacgaagggctcgacgagcgcgagcccgggcgcgaccgacgcggccgaagcgaagagcctgaaccagggcggctggtcgatcggctcggaccgcatgcgttcgtacggcggcggcatcagctacgggttcggcccggccaccgtcggcttcgtctatacgcgctcgcagtacgacaacacgggctcgttcggctcgaccggccaggtcgcgttcaacaactacgacgtgaacgtgcgctatgcggtgacgccggccgtcagcctcggcgcggcctacgtgtacacggacgccagcgtgtcgaaccccgacagcaggcacggcaccgatccgaagtggcaccaggtcgacctgcaggccgtctacaagctgtcgcggcgcacggacgtctacgcggaagcgatgtatcagcacgcatcgggccgcggctaccaggcgttcatcgacggctcgggcggcgcatcgagcaccgcgaaccagatcgtcggcacgatcggcatgcgcacgcgcttctgatcgacgcgatgcatcgccgcccgtcgatcacgcacctgcgttcgcatgcgggttcgttcgcggcgggcggcgcatcaatgttgttccatctggaaggcagcctgcctggaatcggggtttttacgcgcgcgagcgctgcgtagactgccagcgaaggtcggggcgcgcatcgcgcgtcgccccggccacccaccccgtacccaggagaacctcgtgaaatcgctcgtcgttaccgccgccgctgccgtcctgctcgctgcaccggccctgtcgttcgcccagtcggcaaagtcgcccgtcacgcgcgcgcaagtgctgcaggagctgagcgacctcgaatcggtcggctacaacccggcgcgcggcgaatccatcaactatccggacgacatcctggcggcacaggagcggctccacgaaaagcgcctcgcgcaacagaaggccgcgcgcgccgcatacggcccggccggcgagccggcaacggaatcgggcacggcggcaaagcccgcgctgtaacgtcatgacgatgcgccgcgcccacggagacgatgtaccgtgggcgcggcgagtcgcgttggcgtggttggcgaaattcgcgtgaagagaagaagccggctgaagagaagaagccggcgctacgccgatacgcgtcggccgctcaggcggcctgcggttcgcggtcgatcgcgttcagcatctcgacgtcgcgcgcgatcatccccggcacctgggcacgcagcatctcgacccacgtccgcaccttcgcatcgacgaagcggcgcgacggatacagtgcgtacacgttcatcttctgcagaatgtgcgcgggcagcacgcgcacgagcgtgccgtcgcgcagcgcgtcgatcgccgagtaaagcggcagcatgccgatcccgatgccgtcgcggatcgcgagcgcgagcgattcggccgtattggtctgcaccggccccgcgacgtggatctgctcgacgccttcgggcccttcgagcacccattcgtgcgtcgggaacgccggcgtgcacagcgtcaggcacgcgtgcgcggcgagatcctgcggacgggccggcgcgccgtggcgtttcacgtagtcgggcgacgcgcacaggatgctgaaggtcgagccgaggaggtgcgacacgagttccgaatcggggagcgacgacgcggtcacgacggccatgtcgctcgtcccgtcgaacaggtcgggcatgcgctgcgacagcgacagctcgatcgacacgtccggaaactgcgcgtgatagcgcgtcagtgcgggcaatacatagtgatggccgacgctcgcgaagctgtgcatgcgcagcacgccggccggccgttcgtgcgcgcagctcgcctcttcttccgcgcggtcgacgtcggcgaggatctggcggcagcgccgcagatagctttcgccggccgacgtgagcgcgagacggcgcgtcgaacgattcatcagacgagtacgcaggcgcgcctcgagctccgacaccgcgcgcgacatcgcgcccgtcgtcgaattcagcgattgcgcggcggcggtgaaactgcccgtctcgacgacacgcgaaaacacccgcatgttttgtagggtatccattcctgtgagcaacctgtagcggagccgctattttcctctactggatgcgacagattgttactccggctgcaactatcgtttccccgctgcgttaatgcacgggcgccgcgctcctacaatcggcgcctcaccagtcgaacggacccgttcggacgtgccgtggcaccgtgcccggccccgtaccggccccctcttcatgaagccacaacctgcgatcgagcgaccttccatcgaaccggcacgatggagggcatggctcgatccactcggcgacgcggcacgcgactgggccgcgagcgacgggctgatctggctgcacctcgcgaaaaccgtgttcgcggcgctgctcgcgatgggcatcgcgatgcgcctggagatgtcgcagccgcgcaccgcgatgacgaccgtgttcgtgctgatgcagccgctgtcgggaatggtgttcgcgaagagtttctaccgcgtgctcggcacggcggccggtctcgtcgccgcgctcgcgctcggcgggctgttcgcgcagcagcccgagctgtacatggccggcatcacgctgtggatcggcagctgcatcgcactcgcggtgcgcaaccgccacttccgctggtacggcttcgtactcgccggctatacggccgcgctgatcggcctgccggccgtgatgacgccgcagacgctgttccagtccgcgctcacgcgtgccgcggaagtcgcgctcggcatcgcctgctcgggcgcggtcagcgcgctgatcctgccgctcagctccgcgaaggcgctgatgcgctcgctgggcacccgccatgcgacgttcgcggcgttcacggccggcgcactcgcgggcgacgtcgcccgcgccgatttcgagcggcgcttcgcggatttcgtcgacgacatcgtcggcttcgaggccaaccgcgcgttcgcgtcgttcgaggatccgcacattcgcgcgcgcagccgccggctcgcgcggctgaacagcgagttcatgaacgcgtgcacgcggctgcatgcgctgcaccagctcgtcaagcggctgcgcgcgaacggctcggacgcggtgctcgatgcgctcgcgccgcacgtcgatgcgctcgcgcagcgtttcgccgcgctgcgcgacgagcggcagcgcggcatcgcgccggccgccggtgcactggtcgatctgcgccgcttccacagcgcgttgccgaaagccgcgcgcgcctcgcggcgaaacatcgaggaacacgcgcccggcggcctgctcgacttcgataccgcgatcgagctgctgtaccgcttcatcggcgaatacctcggctacgccgacacctatgcgtcgctcgaccaggacgaccatgcgttcgagcgctcggtcacgcattacgcggtgaagaccaatacgttcttcgtcggcttcgcgttcctgcgcacggtcgtcgccgtcggtgcgatgagcgtgttctggatcgcctccgaatggccgagcggcccgcttgccgtgaccgccaccgcgatcgcgtgcgcgctcagctcgacgtcgccgcgcgcgccgaagttcgtggcgcagatgagcgtcggcgcgacattcgcgaccgccgtcggctacctgttcctgtgctacgtgtatccgaacatcgaaggctttccgctgctgtgcgcggcgctcgcgccggtgctcggcgtcggcgcgtttctcgcgatgcggccgggattgtccggttacgggatcggcttcgcggtgttcttctgcctgctcgcggggccggacaacgtgatcgcgtatacgcccgaggtgctgatcaacaacggcctggccgtcgtcatcgcgatgctcgtgtgctcgctcgtgttcgcggtcgtgttcccgactcacatgccgtggctcacgggccgcatcgcgcacgacctgcgccgccaggtcacgctggcgtgcgaaggcgcgccggacggcctcgcgcagcgcttccagtcgagtacccacgacctgatggcgcaactgcgcacgctgctcgtgcggcgcacgcggcagcatcgcgacgcgctgcgctggatgctgtcgacgctcgaagtcggccacgcggtgatcgacctgcgtgacgaaatgaacgcgttccgcgcatcgaagccgccgcagacgctgcgctggaccggctcgatcgacgcggtgctgcacgagctgccgcgcttcttcgacgatccgacgcccggccatcacgcacgcacgctgaaatcggtgaatctcgcgatccgcgccgcgcagcacgcgctgcaggcgtggtatgcggtgcccgacgagcggcaccgcatgcagcgcatcgtcggctgcctgcacttcatgcgcagcgcgctgctggacaaggacgcgccgttcaaccggcatcgccattgatcccatcgatgccatcgacgcccttgacgatcggtgcgtgcgcaacgggatccttgttccggatggaaatatgctctacaggcgcggtgattaatctttaagcagtgcgagcctatagtttcctcactgccagcgagactggcactcacccaggagaaacaaaaatgaagccgctgcacctcgccctcgttgccctgtcgctcaccgctgctgtcgctcacgcacagccggcaccggcagacgacgcacagcaacaggcgaaccgcgtcgaagccgtgaaggccgccggccgcgtcgatcgtgcgcaatcgaagcaggacgacccgaacgcctgcgtcggccccgtcagcttctgcaacatctacttcggcagctgagcatgacgccgcgtcgtcacggccaggcccgcaccgcccgcatgaactgcgcgggcgagcggcggcccggccgatcgcggcccggccgatcgccgcatcgccgctccatcccacgccgcttcgattgaagcggcgcatgccgtttcaggcgccgcgccccggccgccagcccacctcgcgcaacgcatccagcaagcgcgcctgccccagcccttcgacccgcgcaccgcgcgactcgacgtcgccgcccgcgacgagcgcgttcacgatcgcttcctccacagcttccgccgccgcgacgaacagcgcggaaatatggtcgttgttgaccatcttcacgccggtggtcggcgtcccctgctgccgtagttcgccgccggcaggccgtcgttgcccgttgcgaacgcaaggaagatgtcgccgctcgaatcctccgtgccgccgccgacccgcgcgagcccgacactggcacgttgcgcgagccgcgtgcattgatgaggcagcaacggcgcgtcggtcgcgatcgtcacgacgatcgagcccatcccggcctcgccttgcgcgtccggcgcgcggaacggcgaaggcacgtgccgcagcacttcgccgaccgggtagccggccacgcgcagcatctcgcgcacgccgtagttcgcctggacgagcgcgccgacggtccagccgcccgcgtcggccgcgagcacacgcgacgcggtgccgatgccgcccttgaactcgtggcagatcatgcccgtgccgccgcccacgccgccttcggcaaccgggcccgtctgcgcggcggccagcgcgcgctgcacgtgcgcggcgctcacgtgctgcccccagatgtcgttcagcaggccgtcgtaggtttccatcacgaccggcatgcaccagtacacgcggcccgccgccgcttcgcgttcgttcgcgacgagtgcatcgcgcaccgcgccgacgctgtgcgtgttcgtataggcgatcggcgtggtgagcaggccggcttcgcggatccattcgagccccgttgcatcgccgttgccgttcagcacgtgcacgcccgcgaaacagggcgaatcgtgcacggcgcccgcgcgcggctcgatgacggtgacgccggtgcggatcgatgcgtcgccgttctcctcgttcagcgtgcaatgtccgacccgcacgcccggaacgtccgtgatcgcgttgaagcggcccggcgtgccgagtccgatgcggatgccgagatccctcgtgcgcatgatgcaattcctcccgtctttcaatggttcggtgtttcggtgtttcagtacggcaagacttcgatccgtcgctcagagcgcgcggaacgcttcgctgtggcgtgcccagaccgcgtacattgcgagcgcggcaatcagcagaccggcgatgatgatgaggtcggtcggtttcgtggctgtggccagcgtcgtgtagagcgtgtacgcggcgcccgccaccgcgacgagcggcgtcacgggccacaacggcatccggtaatgatgctcgacgtcgcggcgcacgaaccggctcgcgagcgcggccagcccgacgaccaggtagatcagcagcagcaggtcgaccgtgaacgcggtcagctcgtcgaggctcgacacgaacacgagccccgccgacggcaccgcgagcgcgagggtcgcgagccacggcgattcgagacgcgggtggatcgtcgagaaggcacggttgcaggtgcgcgaccagagcgcatgccggccgctgctgtacagcagccggcccatcgtgatcacgatcgcgatgatcgcgttgaacaccgacaggaagatcccgccgctgaccacgcgcgacaccgccgggttgctcagcgaacgcacgacatagccgatcgggtcggcactcttcgtcagctcggtcagcgaaggcgcgccgagcacgatcgcggtgagcggaatcagttcgacgacgaggatcacgagcagcgagtagatcactgccttcgcgacattgcggttgccgccgcgcaggtcttccgcgagatacgcggccgatccgaagccgttgtagcagaagatcgccgtgccgatcgccggaacgatcgcggccagcgtcgcgggcacgagcgcgttgccgctcgcgacgaccggcgcgaccagcgcgtcggcgctgcgatgcggggaaccgaagccgaggcccgcgatcagcatcagcacgccgatctcgaccaccaggaacgcgcccgtgatccacgcgttcgtcttgatgttcagcatgccgagcaggtagctgagcagcacgatcgtcaacgcgaccgactggttgctgaagtgcgtgccgagcgcattgttcaggtatggcgcggcgccgctcgcgagcacggccgggataaacacgctgacggacagcaccgtgatgaaggtgaggtagccgggcagcgtgccgaacacgcgcttggccatcacatactcgccgcccgcgctgcggtgcgcggcgctgagttccgcgtagcagagcgcgaacgcgagcgcgagcacgccgccgagcaggaacgacagcacggcaccgctgccggcctgctggatcgcgaacggcgcgatcacgaagatcgagctcgcgggcgtcacgcccgatacggtgatcatcaccgcgtcgcgcacgctgagcgtctgcgacagcgcgcgcggcgcgtcctccgttgcaggcgccgcttgcagcgtgcccgtcgattccgacatcatcgccatctcgttctcctgtgctgcactttttgaacgcccatactcgggcccgactgattgcgtggcagtctaggaagccaatttcaggaccgctattccccttcgtgttacgcccttccggtggtggtatggatcgtctcttttccgaaatcgcgatgcaccaggcgctcggccgcgcaatcgatcacctcggccagccgcgcttctggcgcttcctggtgctgctgctcaatgaaatggcgccgttcgacaatgcgctcgcgaccgcgatcggccccgacggggtgccgctcgtgctcgaggaatacgacacaggcggcaccgatgccgcgtcgcccgtgccgctctacctgaacggcgtgtatctgctcgacccgttcctgcaggccgcgcacgacgggctcgcagacggctgttaccggctcgaggaagtcgcgcccgacctgttccggcagagcgagtatttcctcagctatttccgcgacgcggtgggcgacgacgagatccagatcctcgtgcggccgagcgccgacatgctgctgtcgctgtcgctgggcgcgagcacgcgtttcgacgtcgagccgctcggcaagctgacggccgcgatgccgtgggtgctcgcggcgatccggcagcactggcggctggtgggcgacgccgcacgcgcgacgcccgacgccgatctcggcgcgcgggtcgagcaggcactcgcccgcttcggcgcgggcgtgctgaccgatcgcgagatgtcgatcgcgcgaatggtactgcgcggcaactcgtcgaaggcgatcgccgagcggctcgcgatttcgccggaaacggtgaaggtgcaccggcggcacctgtacgcgaagctcgggatttcatcgcagcccgagctgttctcgcgcttcatccaggcgctggggaagacgcggccggatgaccttcccgatccggacggatgacaaccggcggtcttcacgttcctgccggaacccggcgccacggtcgggaatgccggcggcgcagcatccgacatgcgagattcaatggaacgaacggttctttttcgtatgcgttgccacggcggcgctgagcggcctgctgtcgctgttgcgaccgaaggacaggcaggcggcgaacgtcgagccgccgccggctgcgcgatagccggcacgcgaacgccgcgcgatgccgctcacccggttttctggcagcggcacgcgcatgcgcggctcccgctaccgccacttcgcgccgagttgcgcgagcccggcgttccggagatcgtccggcaacatcaccacgcggaactcgcagtcggcattcaacatcaggaaccacggctccgcgagcgcggggatctgcgacgggtcatccacgttgacgatcgcgaccgccccgcgaccgccgccctgctcggtgaaatacacggcctccggcttgatcgcttcgagtattcgcgagatcacgtcgccgacgctgccgtctcgcaccagcgtgttgaacggctcgtgagggattcgtatgttgagaagcatgcgcatgaccatcctccttgggcgtcacccggcctgggctcttcaagcataggtgctgcgcgatgccgcgccagtggcgccgaaagcggttgtcggcacgccttcccattccgacgattcgacgacaccgcatcgcgcgaacggcatgcgctcgcgcgatgcaggccccgtcgaatcggccgctcatacccccgtcattcggtgaccgtatcggccgccagctccgtcggcgcgatcgccagatgcaacgcccgctgcggtcgcagcgtcacgttcagcaccgcgcgcggcggcgccatgccgggcggcaacgacagcacatagcgctgcaggaccatggcggccacgaccgtcatctccgtcatcgccagatgctgcccgaggcacacgcgcgggcccgtgccgaacggcatccaggcaccgcgaggcagcgctggcgcatcggcgccgaagcgttcggggcggaacgtatcgggctcggggaaccatcgaggatcgcgctgcatcagttgcagcggcagcatgaacagcgtgcgcgcgggaaactgccacgcgcccagcgcgatcggccgcgctgcgcgacggctgatcaggatcggcgcggacgggtacaggcgcagcgtttcgtcgagcgtctgcgacaggtaacgcaatgacgcgcgcgtctcggccgacggcgcacgaccgcccagcacgcgggacacctcgtcgcgcgcggaggcttgcacggccggattcgcggccatgcaccatgcccaccaggtcagcgccccggcggtcgtctcgtggccggccaggaacgccgtcacgcattcgtcgtgcacggcccgcagcggccatttccgcgcatcggcccgatgcagccgcaacaggcgtgacagcagatcgtcgggccaggtacgctcgggccggtcgaggcgcgcatgcagctgccggtcgatcacccctttcagcaccgccatcgcgcgtgccgtgcggcgcttccacggcacccagctcggcgtgttcaccggctggtaaaacgccgcgttcgccgcggcgctcaccacgcgcaccgcgtcctcggccgcacgcgcatcgtcgccgatcgtatcggagaacatcgtgcgcatgatcacgtccatcgccagcgacgtcagcgcgctttcgatcggccactccggatcatgcgcgggccattgcgcgagggcatgaccggccgtcgccgcgatcgccggaacgaacgcctgaaccggcttcggcatgaagccgggctgcagcgcctgccgcttgtcgcgccacgcatcgccctcggcgaccagcacgctttggccgtggacctccgcgaagacgcggatggcgcgctcccagcgcccgagcgcatcgtggtgcgtgaccagcagctcgcgcacgagcgccggatcggtcacgaccacggcatgctcgggccacacgcgcaagtgcacgacgtcgccgtaggtgcgctgccagtcgccaagcgcgccgatcaggtcgcgcgacatcgtgcgcagcaaccccaacccgtcaggccggcgggcggccccggcggccatacgccgggcgggtgaagcacgggcgccggcgcagcggtgcccgcgtggaatggacatggggaagaggatcgtgtgttcatgtgccggattctccgtatcggcgcggcggcggtcttgaacgcaaacgacatcgacacgcgtgggccccgtccctatactgcggcgtcatgttctccggcccgccatcgattccgccgtcatgccccgatccgcttgcccgcgccctcgcgtcgcgggcggcgggccgctgccgcatgcgcggctgcatcccgcgcctgctgcgctgcagggcgcggtggtcgcgatcgttctgtccgacacgcgcggcgtcgcgtcgagcgacgcgcaacggctttcgcattttccggccacgccgctcgtctgcgtgtcgtggtaccggggtctcgacgtgggcttcatcgaacccgcccccgacggcccgcgatggcgccccttcggcgcggcggcgacgctgtcgggcagccattcggcccccaccgtcgcgtgggcgccgacgggcgggctgatcggcatgatctgtttcaccgccgatgccgcgcggacattgttcggcatcgcgctgccggacatccacgaccgcgtgctcgacgcacacgcgtgcctcggccgcgactggcacccgctgctcgatgcactgctcggcgcggatggcgacgcggacgtgctggcggcgatcgatcgccatctcgcgcctcgctggcaggcgctgcggcccgcgacgccgctggcttcgcttcgcaacgcggggcgcagctgggtcgagcgtctcgcgctacaagcgcgcgagtggcgcggcacgcacagcccgcgccaggtcgaacggcgcatcaagacctacagcggccgatcgctgcgcgaatggcaggcgctcgtcaggacggaaagcgcgttcttcgcggcgcgcgaccggttcgaagccggcaccgcgttcaactgggcgacgctcgcgctcgacgaaggattcgccgaccaggcgcacctgagccgcgaggtcaagcgcatcacgggattctcgccgagcgaattcacgcagcgcttcatcgacgacgaatcgttctggatgtaccggctgtgggtgtgacgcacggcggcttcacggccccggccgcgcgaatgggccatacattccaagagtagaatgttgggcattaacaggcgccattgcctgccccgcccggtcaacccgccatccgcatcattccaggagcccgtgattgaacccgtcgtcgcccgccgaacgcaaaggggtcgccctttatgcgcggattgccagcctgcttcgcggacgaatccatcaaggcgaatggaagcgcggcgaccagttgccgccgattcccgagctgtgtgcgttctatcaggcgggcacgatcacggtgcgccaggcgctggccgaactgagcgccgaagggctcgtgagcagtgcccgcgggcgcggcacgttcgtcacggccgatgtcgtctctccccggataacccggcgctgcgcgccgcgatcaacgatccgctgcaactcgcacccggccagaccctgcgcgtgctgctgcgcgaagccgtgaccgcgctgcccgccgcgttgcagacgggccaacccatgcgcgccgcctacatgcggatccgcacgcttcagctgcacgacggcgcgccttacggtgtgatggacagctacgtcgcgcgggaaacctacgaccggtttccaaagggcagcgacgcgcggcgcaaggtcggttatctcgtccgtcaatacaaccgtcttccgctcgcgaaggcccgccaggaaatcacggccgcctatgcggaccaggagacggccgacctgctcgcgtcggacggtgccgacttcagcatggccgacatgctgattcgcatgcgccgctggtggaccgacggcgacggctgcatcgtccatgcggggctctacctgtatcgcgccgaccgtttcgtgctcgacatcacgcacgatctcgacggcaacgaccggagcgccgacttgatcccgtcaccgcgcgccggtacccggaaaggcgcgcgcaagccggcggcctgacccgcctgccccgactgcccttcgccgccgcgtcgccctcgccgtcgcacatcgccccgtagacccaatgccgcaggtcgcggcgaatccggtatgtcgttgacggcagaagctgtgtcatgaacaccacgatcaggtcctcggccggatcgatccagaaagccgtgctggcgccaccgccccagaagtaatcgccgacgctgcctggctgcatcgtcgcggcaaggtcctgcgtcacggcgaagccgagcccgaacccgagccccggatacacggcctcgctgaacgtggagcgcgacatccggtcgagcgtccggccgcccggcagatggttgatcgtcatcagttcgacggtcttcgggctcaggatccggtgcccgtcgatcgaaccgcggttcagcagcatccggcagaagcgcaggtaatcgccggccgtcgacacgagcccgctgccgcccgaagccagcgccggcggccggcgaaacgcgctggatgccgggtcgtcctgcagcacgagaccgccgtccgggcccgggcaataacacgcacacaggcgctcggcctgctcgtccggcacgaagaaaccggtgtcgggcatgccgatgggatcgaacagcacctgcttcaggtagtcggcaaacggctgcccggagatcttctcgacgagatagccgagcacgtgcgtcgcgaccgaataattccactcctcgcccggcgagtagtcgagcggcagcccggccagatccgcgatcatgccgtcgagaccgcccgggttgcccggttcgccgatcgcaagttctcggtacgcagcatcgacgttcgtcctggcctggaagaaatacgacaaccccgccgtgtggcgcagcagatccaccatcagcatctcgcgcgcgaccggccgggtctggaacccgccgaggctccgtgcgccggccacggcgacgcccagatccttccatgccggaatcacgctcgacacgggatcgtcgagcgccacccgccctgctcgaccagcgtcatgaacgcgacgctcgtgatcggcttggtcatcgaatagatgcggaaaatcgcgtcctcgcgcatcggcttcgcgcgctcgacgtccatggagccgacgacgttcacgtgcgccaactcgccacggcgatggatcatcgtcaccgccccggcaagcgcccggacgccacgtaccgttcgttcagccgcatgtcgagcgccttcagccgctgcgacgacaaacccggatatgccaccttggtcatgcccctgctcctctttccacttcggtctcgacgcgccggaacccgcgcccgcctcgcttcaggcagcgcgcttgtccgatccaaacattctaaaaatagaactatatcattttaaagaatgcccgaaccggcgcgacgcgtcggcaacatgcggcgcgcgtcatgtgggccggttgcccgattcgggacgcgcgggcatgatgtcgcgaaccctggcggctgccttgcgaaccgtttccccggcgcattgccaatgcgccggccgggctgcgtttcgcacacgactgcctcttcccacctcagcccgcttatgtcactccgcgccttcagaacgctggtcgccattgcccgataccggactttcgcgcgcgccggcgaagccatcggcctcacgcaatcggcggtgagcctgcagatcaagacgctcgaaagcgaatacaacgtgcagttgttcgatcgctcgcgccggcagccggtgctcaccgaggccggcaacatcctgctcgcgcaggccgagcaggtgctcgcgatggtcgaccggattcccgatgcgctcagcgacgagaaaagctcgtcggccgcctgcggatcggcgcgatccagaccgcgctgtcgggcccgctgcccgacgcgctgctcgcgctgcgcgccgcgcaccctgggctgcgcgtgcacgtgtcggccggcatgtcggccgaactggcgaaccgtgtcgcggccggcgaactcgatgcggcgatcacgacacgccccgtgcgcccgcatccggcggaactcacgtggaccacgctgtacgaggatcgcttctggctgctcgctccgccggaccaggcggaacgcgacgcgggcacgctgctcggcgcgctgccgttcatccgcttcgatgcgcaggcgtgggccggccgcatgatcgccgccgaactgcgccgcatcggcgtgcgggtgcgcgaggagatggtgctggacagcgcggaaacgatcgcgcgcatggtcgcgcgagggctcggcgcggcgatcgtcgcactcccgattcgacgctcgcgcgcctgccgcccgtcacgcgcttgccgttcggtcagccgcagatggggcgcgcggtcgtcctgctcgaacaccagtcgcgtccggccgaacgtttcgcacgtgcgctggcggccgaagtcaccgcgtcatcgatgagaatttctcattgaacacccgataattaaccattattcctgttgtttgcgcgtgttaacttggcggcatcgtcactctttcgcttgcgtgtcgccatgttgcccgccggatggatgcccgcctcgttccgccgttttgcgtgccagccgctcgcggcagcgcgtgtggcctgcacggtcgccccgcctcatgtgaaggcgccccgatgatcggcccgatcctgctcgcgctggcgccggtcgcgctgctggtcgcgtgcggccacggcctgcggcgcacgggcttcatcgccgacgccttctggccgcaggccgagcggctgtgctactacgtgctgctgcccgcgctgttcgcggacggcctcgcgaacgcgcggttgcagtcactgcccgttttaccgctcgcggcggcgctggtcggttcgaccgcactcgccgcggcgcttctcctgctggttcgcccgttcgtgcgggtcgacggcgccggcttcacgtcggtgttccaggggccgtgcgcttcaacaactatgtcggcaccgcactcgcggccgggttgttcggcgcaaaggcatcgcgctcgcggccgtgtgcgtcgcggcgatcgtcccgaccgtcaacctgatgtgcgtgctcgtattcgcgcgctacggcgacacgcggctcggcgcggcggccctcgtgcgccagatcctgtcgaatccgctcgtcgtcgcgtgcgcgctcgggatcgcgatgcaggccggcggcgtcacgttcccggcggccgtcgagccggccgtgcgcgcgctcggcgtcgcgtcgatgccgctcggcctgctgtgcgtgggcgcggcactgaaattcgatgcggcgcgtgcgtggttgcagccggtctgcgtcgcgtcggcgttcaagttcatggcgatgccgctcgtcacgctcgccgccggccgcctgttcgggctcggcgatgcggcgctgacggtcgcgctgctgttccaggcgctgccgacgtcgtcggcgtcgtacatcatggcgcgccagctcggcggcgacgcgccgctgatggccggcatcaccgcgttccagacgatcgcggcggcgctcgcgatgcccgtcgtgctgaccgcgctcgcgtcggcacccgcgtttcgctgacgacgcaacgaccgcccatttccctgaatccagcctgcacgcgggccatcgcgcgattcggcataaccggccgcgcgtgctcgttcgcgcgttgccgcaggcgctcaccgagtaaccccgtcacatgaatgctcccgccccacccgccgccatcgccgccacccggccgcacgcggccgtctacgtaaagctcacgctcgtcgcgctgttctggggcgggacgttcatcgcgggccggatcctcgccgcgacgatgtccgcgacctcggcggccaccggccgcttcgcgatcgccgcgctgatgctggtcgtgctgacgtggaagatcgaaggcgggctgccgaagctgagcggccgccaggtcgtgacgaccttcgggctcggcgcgaccggcatcttcctgtacaacgtgtgtttttcgcggcgctcgcgcggatgccggcgggccgcaccgcgctgttcgtcgcgttgaacccggtcgccaccgccgtgctgctgtctatcgtcgtgcgcggggaacgcctgtcgctgtcgcgctgggccggcatcgccgtcgcgctgttcggcgcgctggtcgtgatcagccgcggcgaattgctgcgggtgctgaccgatctcggcaacacgttcggtgccggcgaacgcttcatgctgtgcgcggtgctgagctgggccgcctacaccgtgatcggccggcgcgcgctcgacgggctgtcgccgctggcggcgacgacgtatgcggcgctgtggggcctcgcgctgctggtcgtcacgcacctgttcggctcgcccgccggcagcggcacgccgctgacgtggcaggccgtcgcgtcgatgctctatctcggcgcgatcggcacggtggtcgcgttcgtctggtattcgcagggcatccgcgaactcgggccggcccgcgcggccgtgttcaccaacctggtgcccgtgttcggcgtgctgctgtcggtcgcgctgctcggcgagccgttgtcgccgtcgatgctggcgggcggtgcgctcgtgatcgcgggcgtcgcgctgaccaatcgcgcgaaacgctgatcgatgggtgtgcgcgacgcgcactcggggacggatgccgaataccggagcggcgcgcggcggcgatcacgccccggttccgtgacgcagacgggcgaccgctaccgatatgcccccgatacgcccccgatgttctcgcagccccgccaaaaaccgcctatcgtgaatggagcgctccgtttgccgccattcgaccctgcgtcgctcgcaccggcggcgacggccccgcgctccggcaccattcatcgcgatccggcgcacgctcgcccgtgcacgatcgcggccgcccaccggattacaggaggccctcatgaaagccgcgctgctcgtcagctccgccctgctcgccattgcatccgcatcggcgtcggctcaaggctcgatcacgaaagtcgaaaacggttcgctcgtcgccgcgaacgggatgaccgtctacacgttcgacaaggacaaggccaacgccggcaccagcgcgtgcacgggccagtgcgaatccttctggccgccctacaaggccagcgcgaccgacgttccggtcgggccctacacgatcgtcaagcgcgacgacggaagcccgcaatgggcatacaagggcaagccgctgtacttcttctcgaaggacatgaaacagggcgaccgcaacggcgacaacttcaaggacatgtggcacgtggtcgcgccgtaagcgtcgttccgccgccttccgcgcccgccacgaggacgtaaagcccgcccggatcgtcgatccgggcgggcctgctcgcgatcgcgccggccgcgttgcatcgtccgcccgcaggcgggcggtttatgcggccgggtagcgcgtcagcggttcgacgggaagctgaacaccgttccttcgcgcacgccggccgacggccagcgctgcgtgatcgtcttgcgcttcgtgtaaaagcgcacggcgtccgggccatacgcatgcaggtcgccgaacagcgagcgcttccagccgccgaacgagtgataggcaaccggcaccggcagcggcacgttgatgccgaccatgccgatctggatgttgtcgctgaagtagcgcgcggcctcgccgtcgcgcgtgaacaggcacgtgccgttgccgtactcgtgcgcgtcgatcagcgccatcgcctcgtcgagcgacttcaggcgaatcacgccgagcacgggcccgaagatctcgtgctggtagatcggcatgccgggcttcacgttgtcgaacaggcacgggccgaggtagtagccgccgtcgtggccgtcgaccttcacgccgcggccgtcgacgacgagcgtcgcgcccgccgccacgccggcgtcgacgaagcccgtcaccttctcgaaatgctgctgcgtgacgagcgggcccatgtcgacgcccgcgccgttgcccgggccgaccttcatcttctcgatctcggccttcaggcccgcaaccaccttgtcgcccgtctcgtcgccgatcgcgacgaccagcggaatcgccatgcagcgctcgccgcacgacccgtacgcggcgcccatcagcgcgttcaccgcgttgccgatgtcggcgtccggcatcacgaccgcgaagttcttcgcgccgccgagcgcctgcacgcgcttgccgtgcgcgcagccggtcgaatagatgtattcggcgatcggcgtcgagccgacgaagctcacggccttcacgcgcgggtcggtcagcagcgtgtcgaccgcttccttgtcgccgttcacgacgttcagcacgcccggcggcaggcccgcttcgagcgcgagctcggccatgcgcagcgtcgacgacggcgtgcgctcggacggcttcagcacgaacgtgttgccgcacgcgacggccatcggccacatccacagcggcaccatcaccgggaagttgaacggcgtgatgccggctgcgacgccgagcgcctggaactcgctccacgaatcgatcgcggggccgacgttcttgctgtgctcgcccttcagcagctcgggcacgtaggtcgcgtattcgacgttctcgatcccgcgctgcagttcgcccatcgcatcggcgagcaccttgccgtgctcggccgtgatcagcgcgcacagttcgtcggcgtgttcctcgagcagcgtcttgaagcggctcatcacgcgggcgcgcttcagcggcggcgtgttgcgccaggccgggaacgcggcctgcgcggacgcgatcgcggcttcgacggtcagcttgtcggcgagcgcgacgctcttgtgcgattcgccggtcgccgggtcgaacaccggctggacgcggctgccgccgtcgacgcgcttgccgtcgatcaggtggccgacggtggaggtcacattgctgtcgtgtttcatcgttgaggctctttcgtgaatgcggttgtcggtcggtgcgcgccgcggctcagtccacttcgttcagtgcgtcggacagcgcgttgaccaggttgtcgatctcgcgcttctccgagatgaacgggggcgccagctggatcgtgtcgccgccgtagcgcacgtagaagcccttcgcccagcagcgcatcgcgatctcgtacgggcgccgtgccggctcgcccggcagggccgcgatcgtcaggccggcagccagcccgtagttgcggatgtccgcgatatggcgctggcccttcagcccgtgcacggccgcctcgaaatgcggcgcgagatcgcgcacgcgggccaccgcgtcttccttcaccagcaggtcgagcgccgcgacgccggccgcgcacgcaaccggatgcgccgagtacgtgtagccgtgcgggaactcgagcatgtactcggggccgcctgctgccatgaacgtgtcgtagatttccttcgtcgcgaccacgccgccgagcggctgcgcgccgttcgtcacctgcttcgcgaagttcaggatgtccggcaccacgccgaacgcgtcggcgcccgtcatcgcgccggcacggccgaagcccgtgatgacttcgtcgaaaatcagcaggatgtcgtgcgcggtacagatgtcgcgcaggcgcttcagataacccttcggcggcacgaccacgcccgccgaaccggagaacggctcgacgatcacggccgcgatgttcgacgcgtcgtgcagcgcgatcaggtcgagcaggcggtcggccagctcggcgccgtgctcgggcatcccgcgcgagaacttgttttcggcgagttgcgtgtgcggcaggaagtcggcgtcgaggccctggccgaacagcttgcggttcggcccgatcccgccgaccgagataccgccgaagttcacgccgtgataacccttctcgcggccgatcaggcgcgtcttcgtgcccttgcccttcgcgcgccagtacgcgcgggccagcttcagcgaggtgtcggccgcttccgagcccgaccccgtgaagaacacgtagtcgaggccggccggcgtcagttccttgatcttgttggcaagctcgaacgatttcggatggccgaactggaacgccggcgcgtagtcgagctgcgcgacctggcggctcacggcttcgacgatttccgtgcggccgtggccgaggcccgtgcaccagaggcccgacaggccgtcgaagatcttgcggccttcggcgtccgtgtaatacgcgcccttgcccgacacgatcatgcgcgggtcggtcttgaactggcggttggccgtgaacggcatccagtgcgcgtcgagccacgcggcgtcggtgcggatggtcgtgtcgtcctgctgcgcggcggtggtgatgtcggtcatgtcggtcggcgcggcgcgccctccttcttgtgatgatgttgcgcattgtcgggaggccaattagtctcttcaatatcgcaatatcaatgttcacttgcgcaactatgcaagcaaagaaaccgaagagccgcgcgctgctcgggcagctcagcgacatggatctccgcctgctgcgggtcttcaagggcgtcgtgcagtgcggcgggatggcggcggccgaactggaactgaatatcggcatctcgacgatcagccggcacgtgaaggacctggaaacgcgcgtcggcctcgtgctgtgccggcgcggccgcgcgggcttcacgctgacgcccgagggacagaccgtacgaggagacgctgcgcctgctcgcgtcgatggaagcgtttagaagcaggatagacggcattcacgaccggatgggcggcgaattgcacgtcgcggtgttcgacaagacggccaccaacgcaaacgcccgcctcggcgacgcgatccgccagttcgccgacgaagcgcccgacgtcgcgctgaacctgcatgtcgcgtcgatcaacgaggtcgagcgcgggatcatcgacggcagctaccaggtcgggatcattcccgcgcaccgcaattccggcagcctcgtgtattcggagctgttcgacgaacggatgctgctgtactgcggccgccagcatccgctttacgacgcgccgcacggcaagctcacgtggacgacgatccgcaaccacgcatttgcggggctcggcttccattcgccgaacatggagctgagccaccgcgcgaagctcacgcgcagcgcgaccgcgtcggatcaggagtcgatcgcgacgctgatcctgtccggccgttatctcggcttcctgcccgaccattacgcggaaagcttcgaaaacaaggggctgatgcagccgatcgcgccgcaccggttcaattaccggtgccggttcgtgagcctgctgcggcgctcgccgcggccgtcgcgggccgcgctgctgttccagtcgtgtctggaagccgcgcacgcggcgacggcacggccggcggcgtaggcgactcacgcaaaggatcgggctcccggccgcccgccgtgcggcagcgtgccggcaatgaagggatcgacaagcgcggcggcggcaccagcgccccgcccgttcgccccggtcacacgccgtcgaaccggtcgcgcgcgcggtcggcttgcgcttgcgcgcggctgcgcttcacgaaatgcgtcgcgacgagcgccgcgccaaaaccggacatcgcgccgacgccgagcgcccagcgcgggccgagatggttcgcgacccagccggccaccggcgcgccgatcggcgtgccgccgagcgcgaccgcgaggcgcagcgccatcacgcggccgcgcatcgccggctcggtggacaactgcatcaggctgttggtcgagttcatgaaagtgatcgcggcgatcccggtcagcaccagcgcggcagcgaacagccaatagcccggcgccagcgcggcgagcgtgcagccgagcccgaacagcgccgcgccgaaccacagatgccggaagcgcggctgctcgcggcgcgcggcgagcagcgcacccgacaccgtgccgaccgccatcatcgacgacagcaccccgaacccgcgcgcatcgacgtggaacacgctggccgccatcgtcgagatgaacagctggaaattgagcccgaacgtgccgatcaggaacaacatcacgaggatcgccttcaggtcgtcgcgccgccacacgtagcggaacccgtcgagcaggccgccgcgcgagcggcccgcccgcaggttcgcgcgcagttcgtcctcgcggagcagcaacaacgacaccagcaccgcgaagaagctgagcccgttggcgacaaacgcccagcccgtgccgaccgacgcgatcatgaaacccgccgccgccgggccgatcatccgcgcggcgttgaacgacgtcgaattgagcgcgaccgcgttcgcgagttcgcgatcgccgaccagttccgcgacgaaggtctgccgcacgggcgcgtcgaacgccgccgcgcagccgaacaggaacgcgaacacgtagacatgctcgagccgcgcgacacccgtgaccgtcagcgcgccgagcaccagcgccagcacgcccatcagcgcctgcgtcaccatcagcagcttgcgctggtcgaagcggtcggccgcgtagccggtccacggcaacagcagcaactgcggcccgaactgcaacgccatcaccgtgccgacggccgatgcgtcgtgatgcgtgagctgcgtgagtacgagccagtcctgcgcggtgcgctggacccacgtaccgatgttcgacaccagcgaaccgatcgcccacacacgatagttgaaactgcgaagcgaacggaacacgcccgccgccggcacgctcatggccgctcccggtcgggctcgttgccgccgtgcagctcgccgaagtgccacgcgagaaacaggccgagcgcgaggatgccgagaccgaacgccgctgcatcggccgtgacccggaggtcgaaatcgcccactcggcacaccagcacataagccatcacgaggttcgcgacgccccacacgacattcacggtggacgacgacaacccgcgcccgggcggattcgcgaacggggtctggaacggctcgccgcgcaacccgctgacgagatgcggcacgacgttcgcgagaaacgcgccaccgaagaaatacgcgacgagatgcgggaggttcatgttcgggttgtcctttcggcaagcgggtcgatacggttcaagggcgcggcgtttcctggaattcggcgagccgctgcagcagcttcacggcggacgcgagttcggcctgctcggccgccgacagttgcgcgtgcagcgcgcggaacagccagtcatccttggccgcgcggttcgcctgcagcaccttgcggaaaccgggcgtgaccgcgatcagcgtctgccggccgtcggacggatcgggctcgccgctgacggcgcccagcgcctcgagcgtcgcgaccgtcacgcgcatcgactgcgggcgcacgctttcggcgcgcgccagggccgatacggtcgcggggccgtcgcggtcgagccgcaacagcaccgacttctgcgatgacgtgaggtcgttcgggtggatctgctcccgcatccgccgcatcagcttgccgaccgagatgcggagttcgccggcgagaccggccagtgggagcgcgtcggagggagataaaggcgggttcatgaattcaagatagcaggtatgcagtcaaactgtacagtttagctgcatatttcgccttgtaaggaccgtcccttcgcgtgcgctcgagccgatgcgaaacgtcgcgttcagccgcgcaagccggctctgcgataatgcgggctcccatttccgctccgcttcccgccatgacgcagccgtccgctccgctctccaccgacctgccgccgatctcgtgcctgcccggcgacgcgctgccgtggctgccgatgagcgccgacctgcccgggctcgcaatcaagtacctgcacatcaacgcggccgaggacacgctcaccgcgctgctgaaaatgccggccggcggcacgctgccgcgccatcgccacgacggcgaggtattcgtccatacgctgcagggtgcgtggcgctacctcgaatacgactggattgcgcacgccggctcgacggtgctcgaaccggccggctcggtgcatacgccggaaacgctcggcgcgccgggcgaggacgtgatcacgctgaacgtgatgcgcggcgatctggtgctgctcgacgacgaaggccgcgaaaccgcgcgcgagaactgccgcgtcgcgctgctgcgccagcgcaagcatgcgcgcaccgcgccggacgacgccgcgccgttcgtcacgcggtaacactggcggcatcgccgggtcgcgatccgtgcggcgcgggctcgcgctgatgtgcggatggcagccggcgcccttcgccaacgtccccggcctgcccgcgcgttaccgaaaccgccggaaaaaccgccggacatcgtcggccagcagatccggctcctccatcgcggcaaaatggccgccgctcggcatgtcggtccactgcacgacgtcgaacacccgttcgagccagctgcgcggcgggcggccgatttccttcggaaaacgcgcaaacgcgacgggcacggccacgcgctgcccggccgcgaagcgcatgggttgcagccggttttcccaatacatctgcatcgacgagccgatgcagccggtgaaccagtacaacgagatgccggtcagcagcgtgtcgtgcgaaaaccgccgcgccaggtcgccgtcgcaatcgctccacgcgcggaatttctcggcgatccacgcggccagcccggccggcgaatcgttgagcgcgacggcgagcgtctgcggcttcgtcgtgtggacgtgcgcgtatccgccttccagcgcggcccactcgccgcgctgcgtcacgaacgcccgttcctcttcggtcagcggcaaggccgcgtcggtcggcggctcgtagctgccgggcaggaagttcagatggatgccgtccaccacgtcggcatgccgcgcgccgagcgcaatcgacacgcctgcgccgagatcgccgccttgcgcgccgaagcgtcggtatccgagactggacatcagtgccgcccagcggtcggcgacctgaaacgccgacatgccggtgccgcgggcgccggcgagaacaggaagccgggcagcgacggcacgacgacgtcgaacgcatcatccggatcgccgccgaacgccgccgggtcgcagaggcgatcgatcagcgcgtcgaattcgaatacggagccgggccagccgtgcgtgatgacgagcggataaggcttcggcccgacaccgcgtcgatggatgaaatgcacgcgctgcccgcctgcgtctgcgacgaactgcggcagccggttcagcgcacgctccgccgcacgccagtcgaagcgttcggcccagtacgcggtcagttcgcgcaaccaggcgccgtcgacgccctgctgccacggctccgcgggtgtcagcgtcggtacgcgcgtggcgcgcaggcgccggcgcaggtcatcgagcgcgtgatcgggaatcgcaatgtcgaacggggcggtgtgcatcgggtctcctcgcgaagcgggtcgacgagattctgcgcgattttcccggcgcgagcagagcagctcgggcacacgcgtcagcccgcctcccgcccatccgaccgctcatccgcccgcgcgtcgcgccgcaccgcctgcggcggcacgccgaacccgcgcacgaacgcctcgcgcatgtgccgccggtcgcgaaagccgttttccttcgcaatcacgtcgagcgaatggcggctctgctcgatcatcagccgcgcggactccagccgcagccgctcgatcgccttcgcgggcgactgccccgtctcgagcgtgaacacgcggctgaactggcgcgggctcaggtgcaccgcttcggcgagatcctcgacggtcagcgcgcggccgagatgctgccgcgcgtagttcagcgcgttctggatccggtcggatttcggcgcgagatccagcatttccgaatgctgcgactggccgccggcccgccgctggtgcatcacgagcttgtgcgcgaccgaccgcgcgacatccgcgcccaggtccttttccaccatcgcgagcgcgaggtcgaggccggccgtcatcccggccgacgtccagatcgggccgtcgacgatgtagatccggtcttcctcgacgcgaatctccgggtagtcccgctgcaggtcgcggccgaacgcccagtgcgtcgtcgcgcggcgcgcgagcagcccggcctcggccagcacgaacgcgcccgtgcagatgccggcgatccgccgcgcgcgcgttggcgcggcgcaggaacgcgacgacgccgggcggcgccggcgacgcgaccggatcgttgacgcccgcgacgatccacgtatcgacggcaagctgcccgcgcagcgcgtgcgtggcgaccggcagcccgagcgacgagcgcacgtcgccaccgtcgaccgaatagttgcccatcacgtagaacggctcgctcatgcccatgttcgcgtactcgaacaccgactgcgcggcgagcgccatgatctggaagccgtcgctgatcagaaagccgatgcggtgcatgtgcgttctcccttccccggccagtgagttggcccgatgtcctgaatcatacccatctacgtcatttgtgtcacagcgattcacggccagaatggcttcacgccatccggccaatcccatcgaaacggagcacatcatgacgcaagcacatcgcggtaccgccctcattaccggcgcctcgtcgggcatcggcgccgtctacgccgaccgcctcgcgcgccgcggttacgacctgatcctggtcgcccgcaaccgcgaccggctggccgccctcgccgatcgcatcacgaacgacacgcagcgcagcgtcgagatcgtcgacgccgacctcagcgaccgcgcggccctcgccgccgtcgaggcgaagctgaagcaggatgcgagcatcacgctgctcgtgaacaatgcgggcgtcggcacgcacgcgccgctgctcgacagcgacgtcgacgcgatgtcccggatgatcgacctgaacgtgacgtcgctcacgcgcctcacctacgcggcggtgcccggcttcgtcgcccgcggccgcggtgcggtgatcaatatttcgtcgatcgtcgcgatctcgccggaaacgctgaacggcgtgtacggcggcacgaaggcgttcgtgctcgcgttcagccagtcgctgcatcacgaactcgccgacaagggcgtgcaggtgcaggccgtgctgcccggcgcgaccgccaccgatttctggcagacgggcggcctgccgctcgagcatctgccgaaggaaatcgtgatgtcggcgtccgacctcgtcgacgcggcgctgatcggcttcgagcgcggcgaactcgtgacgattccgtcgctgcatgcgggtgacgaatgggccgcctacgaggccgcgcgccgcacgatggccccgcacctgtcggccgatacgcccgcgccgcgctacgcgacggcacgctgaccgtccgacgtcccgcaggtcgaaggcagcaagcgcgtcgccctccgggacgcgccgcggaacccggtgacatgcagcgcatcgccgacgatcatcccgggttccgcggcacgtttcccggcgcgtgccgatcggtggattcgtctgccgaaacatgcaccggattctttcccgatcgacgcaaatcgcgcataccgacagacaattccggttcgcttgccacgcattccacgcaacagtaagctctgcgattgcagtccccaagcggcctcgtccgaccggcattcgtccgatcacgagggcaatcgtccgttgcaaactcgaccatgcgggtccgtatgttcatcaccgagaccggcgacgcgccggcctccgcgcgcggttcggccgaccttcagcccgcgctcccgcccgtgccggaactggccaccgtctgtcgtgtcgcgcgggcgcatttcggtgccgccggcgcgttcattgcgcacgcggatgccgatgcgccacgcgtgctcgccgtcgacggcgcgctgcccgatccccttttcgccgatggcttgccaccccgggtcgagccggatccggccgccgatgcgcggctcgtgccggacgacacgaacgcgaatgcgaacgggcaatgcggcggcggcccgcctcacgcgccgcggatcgtcgcggcctgcgaactggccgcgcccgatggcgcgacactgggcatgctgtgcgtcgtcgacgatgcgcaacgcacgctcgacgccacgcaacgcacgctgctccgcgacctcgccatgctggcggcaagcgcgctttgccgcgcgatcgaagccgccgcgttgcgcgaacggctcgacatcgtcgaggaacacagcacgctgaccacgctcgcgctcaccgaaagcggcaccggtgtgtgggatcgcaacgtggaaaccggcgagatccattactcgccggcctggaaggcattgctcggctacgcgccgcacgagctcggcacccggatcgaggatgcatacgaacggctgcatccggacgatgtcgacgacgtgaaagccgcgatgctcgcgcacttcgagcgccgcaccgaccgctacgcggtcgagcaccgcatccgttgcaaggacggcacctacaaatggatctgcagccgcggcaaggtgatcacccgcgacgcctacggccgcgcgctccggatggtcggcacgaccaccgacatcaccgcgctgcgcgagctcgccacgcggttgcgcgactcggccgcgctcgtcacggatctcaccgaccaggttcccgggctcgtgttccagctgcggcaaacggccgacgggcaccgcttctttacctacgcgagcgcgggtgtcagcgacatctatgaactgacgcccgagcaggtcgcccacagtgcggaggcggtcgagacgcggattcatccggccgacctggtcgcctatcggctgtcgctgcacgactcgtcggtgcggctgaccccgtggcgcctcgaatatcgcgtgctgctgcccggccagggcctgcgctggcgcgaaggcgatgcacgcccgcagcgcacggccgacggcggcaccgtgtggcacggcttcatcaccgacgcgaccgaccgcaagcacatcgaggccgagctgcatcggatggccacgaccgatcacctgacgcaactgtcgaaccgccacgcgttcatgcggcaaagcgaagccgcgctgcgcaacgtgcgcacgaccggcctggccgccgcggtgctgatgctcgatctcgatcacttcaaggcgctgaacgaccgctggggccacccggtcggcgatcgcgcactccggcatttcgcgcggctgctgctcgcggaaaccgggcccgacgggatcgtcggccgggtcggcggcgaggaattcgcggtcgtgctgccgaaggcggatctcgacaccgcgctggcattcgcgcagcgcgtgcagcaacgcgcgatagaggcgcggctgatgcacgaggaccagcaggtcacgctgaccgtcagcatcggcatcgacgcgatgcgggcgtcggacttcggcgcgtaccagccgctgtcacgcgccgacaaggcgctctatctcgcgaaggagcgcggccgcaaccggatcgaggtgtatcgggcgtagccggggcgacggcgcaacgtcgcgccgggcgacatccgcgccgcgtccgccgcccggtttcccggcccccgttgcgcgatcggttcgaaaccgatcgtgtagacttgcgccccttgctctcctcaccacgacttgccatggacaatgccaaacgaaccgcgcgaatcgcgacaggtctgctcgtcgtcgcgctcgtcgagttgctggcgcttctgatcggctacgtgttcgccagttcgatggacgatccgtacgccggcgttcgcgtgctgattaccgcactgttctgggcggcgggcctctcggccatcggcgtcatcgcggcgatcgcctgcctgtcgatcgacctgcgggcacgcggtggcgtgatctacggggcgctggtgctgcacggcctgctcgtcctacccgggctgtttctgtccttccactgaatcgcaccgcagccgccggcgtcacgccgcctccgcacgcggcaccgcccgcacccccagcagcatcgcgaccgcgcacgcggccaacagcgcggcgatcatcagcatcgccggatccatgctgccggttcgcgtgcggatcagcccgacgagccaggggtgatcatgccgctcgacacgccgatgctgctgatcagcgcgatcccgccggccgcgcccgcgccggagaaatacgcggacggcacggcccagaacaccggatgcgcggcgaagatcagcatcgccgcgaccgacagcagcgccatcatcgcgacgatgctcggcaggtgcagcgtcagcagcgcaagcgccaccgcgccgccgaacgcgcatgccgcgaagtgcctgcgccgctcgcgcttgcggtcggaacgccgcgcgatcgcgatcaggccggccgcgccgatcgcattcggcacgaccgacagcaggctgatctgcacgacgtcgtggatgccgaattcgcggatcatcagcggcatccagaacagcagcatcagaagcgcggtggtcagcgagaaatagatgaacgcgaacaggtacgtgcgcggttcggccagcacctgccgcagcgaatgcggcgccggcgtatcgacaccggcggcaccgacagcaccggcgcggtcggcggccaggtcggccgcaagccgctggcgatcggcgtcggacagccagcgcgcctgctcggggcgatcgcacagccagaaccacgcgatcacgccgagcaggatcgcgggcgcgccctcgatcgcgaacatccattgccagccgtgcagcccgagcacgcccgacatcccgcgcatcagccagcccgacagcagcccgccgaccatccccgccaccgcgacgcccgcgtagaagatcgacagcaccgacgcacgccgccgcgccggataccagtacgtcaggtagaacaccacgcccgggaagaacccggcctcgaacagcccgagcaggaagcgcagcacgtagaaatgcttcgcgctgtcgacggtgatcatcgcgaccgacaccgcgccccacaggcacatgatccgcgcgaacgtgcggcgcgcaccgaagcggcgcagcaaggcgttgctcggcacctcgaacagcacgtaaccgacgaagaacagcacggcgccgaggctgtacatcgcgtcggtcaggccgagatcctgccgcatctgcaactgcgcgaagccgatgttgctgcgatcgaggatcgacacgatgtagcagatgaacaggaacggcacgatccgcatgccgatgcgccggtacagcgcgtcgtcgtccggtgcagcggcgccggacgcgacggcacgcgcggcatcggcttgaagagggctgacatcgatcgtctcctcgatggattcgggtgcggggcgaacaggggcgccggtcgccgccgcccgcgcgcggcgaccggccgttgcgcgttcagtcgcgcggcgcggcttcgcccttcacgccgagcatcagcgcgacgccgctcgccaccagcaacgcggccagcagatacacggcgagatccatgctgccggtgcgcgtgcggatcatcccgatcacccacgggctgacgatgccgctcgtgatcccgatgctgctgatcagcgcgatcccggccgcggccgcgttgcccgacaggtagcgggtcggcacggcccagaagatcggcagcgcggcgaagatcagcgtcgccgcgatcgacaggcacgcgagcatcgccgcgaagctgtgcaggtgcagcgtcagcgccgcgagcgcgatcccgccgccgatcgtgcagcacgcgaagtgcttgcggcgctcgccggtccgatccgaacggcgcgcgatcaggaccagccccaccgcgccgaccgcgttcggcacgaccgtgtacaggctcacggccacgacgtcggtcacgccgaaatcgcggatcatcagcggcatccagaagttgagcgtcagcgacgcgcaggtcagcgagaaatagatgaacgcgaacaggtacacgcgcggattggcgagcgcggccacgaggctgcgcccgtcgtgcgcgtggccgtggccgcggccgtcggcgcacagcgcggcgacccgcgcctttcatcggccgtgagccacgcggcatcctgcggccggtcgaccaggaacgtgaacgcggcgaacgcgagcaggatcgccggcgcgccttcgatcgcgaacatccactgccagccgtgcaggccgagcacgccgcccatgtcgcgcatgatccagcccgacatcaggccgccgagcacgccggccaccgcgacgcccgcgaagaacaccgagatcgcggccgcgcgccggttcgcggggaaccagtaagtgaggtacagcacgatgccgggaaagaagccggcttcgaacacgccgagcaggaaccgcagcacatagaaatgcgacggctgcgacacgaacatcatcccggtcgacgcgatgccccacagcagcatgatccgcgtgaaggtgcggcgcgcgccgaaacgcgcgagcagcatgttgctcggcacttcgcagaacacgtagccgacgtagaacaccgcggcgccgaggccgtacatcgcgtcgctgaagccgagatcgtgcttcatctgcaactgcgcgaagccgatgttgatgcggtcgaggaacgatacgacgtaacagaggaacaggaacggcacgatccgccatgcgatcttgcggaacagcagcgcgtcgtccgtggcggcggatgcggaagccgaagcgctcgcgtgcgcgagcgtcgcttcggcatgaagcgattggggcatgtctcttccaaacaggctgcgcgattcgggcgcgcagccgtctcccagggcgtacgtgcgccctgctttctagtgagctcggatcacggcggacggcaagacggcggaacaccgcggccggtcgccgcttcagaaaaaggcggagcgccctgtcggacaccccgcctgtgcaagccgctcagtcctgcagcgcggcccacatttccttgtcgctgcgcggtccagatgcgcggatgcgtgatgccgctcgcttcgtcgaacgcacgcgacacgtcgaacggcaggcagtgctcgtagatgaacacgtggccgaacttcgggtccatcgcttcgcgcgtgagcgccatcgatgccttcaggtcgagcttctgctcgacggccttgcggccctgcgcgagcagcgtcgtgacgaaatccttcgtgtagtcgaggcccttgttcacttcggccgggttcagcagcgcggggccgcggcccggcaccagcttctcggcgttcagcgcgcgcagcgcctcgagcgtggccggccactgttcgagctgcgcatcgccgcagtagcacgcggcgtcgtattcgacgaggtcgcccgagaacagcactttctgcgacgggatccagacgatcgtgtcgcccttcgtgtggcccgagccgacgtgcatgatcttcacctcgagcttgccgaggaacagcgtgatctcgcgttcgaacacgagcgtcggccaggtcaggccgggcaccgtctcgacaccggcgaacaggcgcggaaaacgctcgatctccgacttcatgtcggcctcgccgcgctcgacgatcatctcgtacgtgccgcggctcgcgatcacgtgctgcgcgccttcgtcgaaatacgcggacgcgccgagcacgcgcaccgcgtggtagtgcgacagcacgacgtgcttgatcggcttgtcggtcacgctgcggatcttcgcgatcaggtcctgcgccatcgcgggcgtcgcggtcgtgtcgacgatcagcacgctgtcgtcgccgatgatcacgcccgagttcggatcgccttcggcggtgtacgcgtacgcgttctcggacagcttcgtccaggtgactttcttctcttccagatcggcttgggaggcgaatgctttggccatgttgcgttccgtggctgcgagccatgtgttgagggagtgagcggatcatcttctcgcgccgaatatttgtcaatgacaaagtcacttgctattgtctaatacgggtaaacctgcgggctggcgcgataaatggcgtcggataccatgcggggtttcgtcaacggaagaatcatcgcgtgcagaaccacgaagtcagcgcagacgatgcgccgcccaaggcgcagcgcgggatccagagtgtcgaggtcggcggccggctgctcgacgcgctcgcgcgccggcgcaagccgctcggactgtccgagctggccgcggcggccgacctgtcgaccgcgcaggcgcacacctatctcgtcagcctgacccggctcgcgctcgtgaagcgcgacgcgctcaccggcaactacgagccgggcccgttgtcgctgcggctcgggctgatgtcgatcgagcgccagccggcctatcgcgcgacgctgccgcacgcggcacggctcgcggaagcggtcggcctgagcgtcgcgctgtcggtgccgggcgcgctcgggccgacgatcgtgcgcatcgagcacggcggttatccgctgcacgtgaacctgcatgtcggttcggtgatgtcgctcgacacgacggccaccggccgcgtgttccgcgcgttcggcgaccccgcgcaactccgcgcgatggccgccagccaggccggcgcggccgacacgcttgcaggcggcgagcagcccgtgccggacaccggcgtgccgcaggccgagctcgacgcgatccgcgcacgcgggatcgagcgcggcgtcgacctgccgagccccggcgtcagcgcgatgtgcgtgccggtgttcgacgcggcgggcgcgctgcagctcgcgttgacggtgatcggttcgacaggctcgatcgacgtcgcgtgggacggcccgatcgcggcggcactgcgcgacgcggcgcggcaggcgagcgcatcgctcggcgcggcgcacgatgccccgccgcccgcacccggcgcagccccggccgctccgcgcgtgccgcccgcgctggccgacgatgcgaaggcgcagcgcgggatcaacgcgctcgacagcaccggcgagctgctgctcgcgctggtgtcggcgggccgcgcgctgccgctgcgcgacctcgcggcggcggccgggatgccggccgcgaaggcttttccgcatctcgtcagcctgcagaagatcggcctgctgagccgcgacgacaccggctgcttcggcggcggcccgctcgggcaggcgctcggcctgatcgcgatgcagcgcgtgtcgccgacgcgcgacgcggaagccgagatcgtcgcgctggccggcgcgaccgacatgagcgtggcggccgcgacgctcgggccgctcggcccgacggtgatccgcctcgaggaatcggcgcggccgcagcacgtgagccttcaggtcggcaccgtgatgtcgctcgtcaatacggcgatcggccggattttcgcggccggcatgtccgacgacgtgctggccgacctgctcgccgacgagcccgtgcgcctcgcgggccgcaccgccccgccgaccgacgacgcattccgggcgcggctcgcgacgatccgcgcggacgcgctcgatttcgcgttcgacgcgccggtgccgggcatcgggacggtcgccgcgcccgtgttcgatcacaccggcagcatccggctcgtgatcgcgatcatcggttcgtcgcgcggcttcccgcgcgggccggacagcgatctcgcgcaggcgttgctcgccgcgacgcggcggctgtcgtggcggttcgggtggatcggcccgtaagccgacgcccgcctccgccatcctccgcaacgcccgaatcccctctcttgttcgatgcgaggccgtgccggcacggcctcgtcgcgccagcacggccgcgccaaggcacccgatattcatgttgcgaagcagcaacacaaattgtcagtaattctcatataacgaaatcgcatttcacaaggcggaggcgtttcgctatgattagggttatccctaactcgccacctatatggggcttcgtcatgcaaacgtctaatgtctccgaccgttccaccgaatccgctggctggctcgcacgtgtgggcgagctgattgcagaagcttgggcactccacctcgagacctgcgaagtcatcgctgaagcacacgcacgcctgccgcgctgagcggtacgaccggccaacagccggccgcacgatgccgtcctgatccgcttgcccggatgcgcgccacaaggccgcggcatccggcaacgcctggcgcggcaaacaatgtggaaaccggcaagagttgccccggttgaatgcgctcccggtgccgggagcgtgtcgaggtcgctttgaagccgatgccggcgccaatccgcgtcgacgcggtatcgaatcggcttcggcgcagctctgtctgacggttgcccgggcgggcaaccgttatccagccagcacgtgggtagtccggaccatcgcggacagaagattcatccgcgttgccggccgcggttccgaaccgcgccgcgcgccttgtcctccgcccgattgccggctttctccgcgcatacgcgcagccacaagcgccatcgtttcaacgacggccgcatttcccgctgccttcctcacacctgaatcgacggcacgtccttcatgcagcgcagtgcaaacatcgagcggctgtgacggatgctcgaaatcttgtacagcttttcgcgcaggaagcgctcgtagccggccgtgccgtccaccgcgaccttgatccagtagtcgtactcgcccgacaccagatacgcctcgagcacttcgggcagcgcggcgagttcctcgccgaagcgggcgagcgcgtcgtcctcgtggcgatcgagcgtgacttcgaggatcacgatgtccgcataacccagcttccgctggttgacgagcgcgacataaccgtcgatgtagccgtccacctcgagttgccgtgtgcggttccagcacgcggtggtcgacatgccgatctgttcggccagttcggcgttcgacaggcgcgcatttttctgcagtgcacccaggatcttgcggtcctggctgtcgagcgttttcggcgagcgttcacgtgtggccatggcaggaagaatcttctactgaaaagcgcgattctatctgaacgacattccggatttgtgtcggtttgtgtggaaatgcggaagccttttaatccggccccttgatatattttccccatgcctgttgtccggcacgctccccgcgacaaccccttcgcagcgggacgcacggccgcaatcacgagttgcggtgccggccagcaggcatgcgattcccgccgcccgcgcgcctatccggccgcgcggcttcggcgcccgtgttcctgttcctgccctacccgtcatgtcgttcaggctttacctctcgtttctcgctgcttccgccgttctcgtctacgctcccggccccgtcaacctcctcaccatgaaccacgcactgcgcgccggctggcgccgcgcgctgccgtgcgtctggggcggcacgctcgccgtgctgctgcaactcgcgctgaccgcgctgtgcctgaattcgctcgtgcatctcgacgagcgcgcgctgaccgtgctgcgctgggccggcgcagcctacctcgtctggctcggctgcaagcaatggctcagccgcacgccggccggcgcgtccgctacggctgggcccgccggggcggcaacgccggaggccgactcgcaccgcgcgctgttctggcgcggcctcgcgacctcggggctgaatccgaaaacgctgctgttcttcccgtcgttcttcccgcagttcatcgtcccggacgccgactggagcctgaaccagcagttcctgctgctctcggcgaccttcgcggtgctgttcgcgggcggcgtcgcgtcgatggcgctgttctcgcaccggctgagccgcgcactgcagcggcccgcgcggatgcgcgcgatgaaccgcgtcacgggcgggctgctcgtcgggatgggcgcgatcatggccggctggaattgaacagccgccgctgcgcgcgtcgtcgccaccgccgccgggccccgcgaaaaagcagccgatcgcggaatgctttagggtagcgcctggttcgttggacatgcccggcctgccgggcgactgaatgaagcacgtcactacccgcctgcggcgcctgttcgcgccgatcggcctgcattggtatctcgcccttctcctcgcgctcgatgcactgatggtgctgcgcccggtcgtcgacaacgcgaagctcggccgccacggtgcgtggcttgccgatgcgctgaacctcgtcgacaacgcggggctcgtcgtgctgccgcaggtcgtgatcgcggccggcctcgcgaccatggccatcggcatcttgctgcgcgcgcgcgtcgcgtgggtgctgtcgatcctgctgctggtcgcggccgccgcgctcagcgcgctcggcggctatccgagccacggcgtgttcgcctacacggccgtgctggtcgtcgcgctgctttattactggcggcatttcgaccgcgcgagcatcgccgcgagcagcctgttcgcgttgctgagcatcgtgtcgctgctgatctacgccaccttcggcgtgctgtacctcggcgacgaattcacgccgcccgtccacgacctcgccaccgccgtctatttctcgatcgtgtcgatgtcgacggtcggctacggcgacatcgttccgcacgcgccgaccgcgcgcctgttcaccgcctcggtgatcgtgctcggcatcacggtgttcgcgacgtcgatcagcgccgtcgtcggccccgtgatcggcggcaatctgaaacggatcgtcaaggaggcatttcgaacgtgatccgcaagcatcatttcctgatcgtcggcgcgacgcccgtcgcgcatgcggtacacgacgggctgcgcaagcgcggctacgcggtgaccgtcgtcgtgccggccggcgtcgagcacaactacgcggcggcgaccgacctgatcgtcggcgacgcgaccgaccatgcggtgctggaaagcgccggcgcggcgaccgcgcgcgcggtgctcgcgctgcgctccgacgacgccgagaacgcgttcatcatcctcgcgatccgcgagatcgcgccgtcggtgcgcacggtcgcgctcgtgaaccagcagcgcaacctcgaacggctgcgcctgttgaagcccgacatggtgttttcgccgcagcagctcgcgggcgaactgctcgcgagcacgctcaacgacgaaccggtcgacaagtcgatgatctcgcacctgctgttcggcacggccgatgccgcatgacctgtcgggcccgtgaccgcatggcctcgtgaccgcatgacccgcggcggccggcatgcgcccggtacaatcgcgcgatgtccgaattgctcacttacggcggcctgttcgccgtgtcgatggtcgccgcgaccctgttcccgctccagtccgaagccgtgctcgccggcctgctgctcgccgggcgcgaacccgtatgggcgctggtgctcgtcgcgagcgtcggcaacgtcgccggctccgcgatcaactgggcgctcgggcgcggcatcgagcacttccgcgcgcgccgctggtttcccgtcaagcccgccgcgctcgcacgcgccgagcgctggtatgcgcgctacggccgctggtcgctgctgctcagctgggcgcccgtgatcggcgatccgctgacgatgatcgccggcgtgctgcgcgagccgctgccgagctttctcgcgatcgtgacgatcgcgaaggtcggccgttacctggccgtcgcgtggctcgtcacgcactgacacccgcgttcccgccgcacctgccggcgtcgccatcgacgacgcgccgctaaagaattcgccgctgctgccgtattaaggtcgatcagcggtgacgcgtgcgttccgccctctccctccccactcaggaagtttcatgagattgacccaattgggccgggtgagcgtcggcgcgcgtcttgccgcgctggcgtgcgcgctcgtcgccctgctgtttaccgtgttcgcatggacgctcgcccatttcgccggccggcaactcgccgaagaggcgcacctgcggatcgccgacaacgagcagtcgatccgcgcgatggtcgacctgttcgacaaggcgctgaccgccgaagccgatcgctcgatgtcgctgttcgcgagcttcctgccggccgagttctcgatcgacccggcgcgcaccgtcgacatcggcggcgtcgccgcgccgacgctcctcgcgggcggccagccgctcgacctcgactattcgattcccgaccagttcctgaagaaaagcggcgcgatcgcgacgatcttcgcgcgcgacggcgatgatttcgtgcgcatcacgacatcgctgaagaagcaggacggcgcgcgtgccgtcggcacgaagctcgaccgtgcgggccccgcgtacgccccgctcgtcgccggacgcgtgtacacgggcctcgcgaagctgttcgggcggccgtacgtcacgcaatacaagccggtgaccgatgcgaccggccgcgtgatcggcgcgctgttcgtcggcctggacatcggcgccgagctcaagctcgtcgaggacggcatccgctcgctgaagatcggcagcaacggctactacttcgtgctcgacgcatcgcagggcccgtcgcgcggcaccttcgtcgtgcatcccgatgcggccggcgcgcctgccgacgacacgcgcgcgccgtacgcgcagatgctcgcggccggcgcgggacagctcgcatacacgtcgaccgacccggccgcgcacgacagcgggcccaccgcgaaattcgtgtcgttcacgacgattccgcagtggcagtggctcgtcggcggcatcgcgctcgacgacgaactgctcgccggcatgcgcgccacccgcaaccgcttcctgatgatcggcgcgttgctcgtcgcggcgttcgcgacgctgttcgtcatcgtggtccgccgtgtcgtgagccggccgctcgatgcggcggcacgcgcctccgagcgttatgcggcgggcgatctcagcgtgcgcatccgcgatgacgcagccatgcgcggccacgcgggccacgccggcaacgacgagatcggccggctcgtgcaggccgtcgacgggatcggcgacggcctcgcccggatcgtcgagcaggtgcgcaacagctcggccgacatcgcgcgcggcaccgtcgacatcgcggccggcagcggcgacatggccgcgcggatcgcgacgcaggcgagcagcgtcgaacagaccgcggccagcatggaacagatcaccgccgccgtgcagcagagcgccgagcacgcggcgcaggccaacgcgctggtcgctcacgcgtcggccgccgcgacgaacggcgacgccgcggtgcagcgcgtggtcgcgacgatggacgacatcggccgcgcaacacgccggatcgccgagatcacgggcacgatcgagggcatcgcgttccagaccaacatcctggcgctgaacgcggccgtcgaggccgcgcgcgcgggcgaacacggcaagggcttcgcggtggtcgcggccgaggtgcgcacgctcgcgcagcgcgcggctgccgtgaaggagatcgacgcgctgagcgccgaatcgtcgacgaccgtcgaacagggttaccggatcgcggacgccgcgcgcggcacgatgcgcgacatcgtcgcgcgcgtcgaccaggtcagcacgctgatcggcgagatcagcgccgcgtcgcgcgaacaatcgaccggcatcgaacaggtgaacctggccgtcacgcagatcggcgacgcgacgcagcggaatgcatcgctgatctcggacgccgaacgcgcggccgtcgcgctacgcgaccaggccgcgcagctggccaatgcggtcagcgtgttccgcctcgagcggaacgcatgaccgcagacggacgatcggccagggccgggcggctcgcctacttcttgtcgccggccaggtcgatcgccttgtccgagccgaccgcgttgcgcagctggaatttctggatcttgccggtcgacgtcttcggcagctcgccgaagcgcacgaccttcggcaccttgaagcccgcgagcaactgccggcaatgcgcgacgatctccgcttcggtcgcgctcgcgccttcgcgcagctcgacgaacgcgcacggcacctcgccccatttcgggtcgggcatcgcgacgacggcggcgaccgccacggccggatgccggtacagcgcatcctcgacctcgatgctcgagatgttctcgccgcccgagatgatgatgtccttcttgcgatccttgatccggatatagccgtccggcgtcagcaccgcgagatcgccggtatggaaccagccgccgtggaacgcgtcgtcggtcgccttcgggttcttcaggtagcccttcatgcagatgttgccgcggaacatgatctcgccgagcgtctcgccgtcggccggcaccggcgccatcgtgtcgggatcgagcaccgtcgcgcccgcttccaggtggtagcgcacgccctggcgcgcattgagccgcgcacgctcctcatccggaagttcctcccaatgcgcctgcttcgcgcacacggtcgccgggccgtagacctcggtcagcccgtacacgtgcagcaggtcgaagccgatctccttcatcttcgcgatcacggccggcgcgggcgccgcgcccgccaccatcgcgtgcaccgtgtggtcgatgccggcgcggaattcggccggcgcgttcgcgatcgcgctctgcacgatcggcgcgccgcagtagtgcgtgatgcgttcgcggcgaatcaggtcgaacaccgtcttcgcgtcgaacttgcgcaggcagacgttcacgcccgcgcgcgccgcgacggcccacggaagcaccagccgttgcagtggaacatcggcagcgtccacaggtagacggcgtgcttcggcatgtcccattcgaggatgttgctgatcgccgcgagatacgcgccgcgatggtggtagacgacgcccttcggatcgccggtcgtgccggacgtgtagttcagcgcgatcgcgtcccattcgtcggcgggcggagtccacgcgtagtcggcgtcgccgcttgccacgagcgcctcgtagtcggtcgcgcccgcgaagcggggggtccgccggcatcgcatcggccacgctgacgatcttcaggcccggcacttcgagcgccgcgcgatgcgcgaattccgcatactcggtgtcgacgatcagcaccttcgcctcgccgtggcgcagcatgaacagcaccgacgacacgtcgagccgcgtgttgatcgtgttcagcacggcgccggccatcggcacgccgaagtgcgcctcgaccatcgccgggatgttcggcagcatcgccgcgaccgtgtcgccgcggccgacgccgagccgcgcgagcgcgctcgccagctgcttcgcgcgcgtgtaggtctcgccccaggtgcgccgcacgtcgccgtgcacgatcgcgaggcgctcgccgtagacttcggccgtcctgaccaggaagtcgatcggggtgagcggcacgtaattggcgtcgcggcggccgagtccggcctcgaacatctgcgtcatgatcctgtctcccgtgttctgtcgaccggggcgcttccaccccggatcgttttgatgtggttcaattgccgacagcctaacgggcgctattgtgagccgtctgtcatcgaaacgacagagtgcctttccgcgctgcgcgttatccctatcctcgcaaacccgcacccatgcacgaccctctcgccgcaccgcccgacgcgcccgccaacccggccgacgccctttccgcaccgggcccgctgccggcgctgtccacgctgttcggccagtgcgcgtggttccgcacgctcgcgcccgaacaccaggcgctcgtgctcgcgcaatcgcgcgtcgaacagtgcgaggccggcgacgtgatcgcccatcggctcgcgccgtccgaatactggatcggcgtgcatcgcgggctgctgaagctcgccatcttcaatgcgtccgggcgcggctgcacgttctccggcgtgccttccggcggctggttcggcgaaggcagcgtgatcaagcgcgagctgcgcaagtacgaggtcgtcgcgatccagcgctcgaccgtgctgttcgtgccggtcgacacgttccacgcactgctcgacacgagcctgccgttcacgcgcttcgtgattcatcagttgaacaaccggatgggcgagttcattgcgtcgatccagaacagccggctgctggacgtcgacgcacgcgtcgcgcagtcgctcgcgcagctgttcaatcccgacctgtacccggacaccggcccgtcgctgtcgatctcgcaggaggaactggggatgctcgtcggcgtgtcgcggcagcggatcaaccaggcgctgcagcagctcgagaaactcggcgtgctgcggctcgcgtacaaccagatcgaggtcgtcgatctggggcgctcgcgcgtgtcgggatggagcagatctgagcgcgggcccatgagcggaaccgccgcaggtgcagccggcccgtccggtatcgcgaccgttttgcggccgttttgcggccggcgcgccgcgcggcgtttcctctgccgaatcggcgccgggccgccccgccgcaacctgacaattccgccagtttcgtgacagtaacccgttccacgccgacgcctatcatgcgggttcccttcaccgacgcctgatcaccgcctgtcccgccgcctccatgtggatcgtcaatcttgcgctcaggcgcccctacacgttcatcgtcatggccatcatgatcgtgctggccacccgcttgcgctgatgcgcacgccggtcgacgtgctgcccgcgatcaacatccccgtgatcagcgtcatctggaattacagcggcttctccgcgacggagatgacgaaccgcatcacgtccgtgcatgaacggatcctgacgacgaccgtcaacaacatccagcacgtcgaatcgacgtcgctgcccggcatcgcggtcgtgaaggtgttcctgcaaccgggcgcgaacgtgcagacggcgatcgcgcagacggtctcgtccgcgcaggcgatcgtgcggcagatgccgcagggcgcgacaccgccgctcgtgatcacctattcggcctcgagcatcccggtgatccagctcgggctgtcgagcaagacgctcagcgaacagtcgctcgccgacatcgcgctcaacttcctgcgcccgcagctgatcacggtgccgggcgtgcagatcccgttcccgtacggcggccgcacgcgcgtggtcgcgatcgacctcgatccgcaggcgctgctcgcgaagggctcacgcccgccgacatcgtcaacgcggtcaacgcgcagaacctcgtgctgccgaccggcaccgcgaagatgggccagaccgaataccggatcgacaccaacgcgtcggccgatacggtcgccgacatcaacaacctgccggtccagaccgtcaacggcgcgacgacctatctgcgcgaggtcgcatcggtacgcgacggtttcgcgccgcagaccaacgtcgtgcgccagaacggccagcgcggcgtgctcatctcgatcctgaaaagcggcgacgcgtcgacgctcaaggtcgtgtctgacctgaaggcgctgctgccgaaggtgatcccgacactgcccgaagggctcacgatcacgccgctgttcgaccagtcggtgttcgtcgacgcggccgtccagggcgtgatccacgaagcgctgatcgccgccgtgctgaccgcgatgatgatcctgctgttcctcggcaactggcgcagcacgctgatcatcgcgatctcgattccgctgtcgatcttcacgtcgctgatcgcgctgtccgcgctcggcgagaccatcaacatcatgacgctcggcgggctcgcgctcgcggtcgggatcctggtcgacgatgcgacggtgacgatcgagaacatcgagcggcacctgcacctcggcacgaacctgcatgacgcgatcctcgaaggcgccggcgagatcgcggtgcccgcgttcgtgtcgacgctgtgcatctgcatcgtgttcgtgccgatgttcttcctcacgggcgtcgcgcgtttcctgttcgtgccgctcgcggaagccgtcgtgttcgcgatgctcgcgtcgtacgtgctgtcgcgcacgctcgtgccgacgctcgcgatgctgctgttccgcccgcagcaggcgagcgccggcccggatcgttcgacgtcgcgcttcgcacgcatccaccacgcgttcaacgaagcgttcgagcggctgcgcgcgtggtacatcgtgctgctcagcatcctgctggtgcgccgccgcttctacgcgacgtgcttcctcggcttctgcgtgctgtcgaccggcctcgtgttcgtgctcggccgcgacttcttcccgaacgccgattcgggcaacatccgcctgcacatgcgcgcgccgaccggctaccggatcgaggaaaccgcgcgcctcgccgaccaggtcgagcgcgtgatccgcgaaaccgtgccgcccgacgagctcggcgcgatcgtcgacaacctcggcctgccggtgagcggcatcaacctgtcgtacagcaacgccggcacgatcggcacgctcgacggcgagctgctgatcgcactgaagcccggccaccgcgcgacccagcactacgtgcaggcactgcgcacggtgctgcccgagcgcttcccgggcgtcgagttcttcttccagccgtcggacatcatcacgcagatcctcaacttcggccaaccggccgcgatcgacctgcaggtgctcggcaacgatctcgcgagtaacatgactatcgcgagcagcctgatgaaaaagttcaggcaaatccccggcgccgtcgacgtgcacgtgctgcaacgcaacgacgagccgaccctgctggccgacatggaccgtacgcgcatgcagcagctcaatctctccgcgcagaacgtcgcgcagaacatgctgatctccctgtccggcagctcgcagacgacgccgtcgttctggatcaacccgcgcaccggcgtccagtacccgctgcagatccagaccccgcaatacagcatctcgtcggtcgacgacctgctcggcacgccgatctcggcgagcggccgcacgggcatgccgctgcaactgctcggcaacctcgtgcaggtgcgcagcaccgcgaacccggccgtgatcacgcactacaacatccgcccggcgatcgacgtgtacgtgagcgtcgagggccgcgacctcggcgcggtcgcgggcgagatcgaccgcatcgtgtcggatgcacgcgcgacgctgccgcgcggcaccgagctgacgatgcgcggccagatcgagacgatgcgcacgtcgtacctcggcctcggcgcgggcgtcgcgatggcgatcgtgctcgtctacctgctgatcgtcgtcaatttccagtcgtggctcgacccgctgatcatcatcagcgcgatgccggccgcgctcgccggcatcgtgtggatgctgttcatcaccggcacgcacctgagcgtgcccgcgctgacgggcgcgatcatgacggtgggcgtcgcgaccgcgaacagcatcctggtcgtgtcgttcgcgcgccagcgtctcgaagccggcgcgccgccgctcacggccgcgctggaggccggcgcgacacggatccggccggtgctgatgacggcgctcgcgatgatcatcgggatggtgccgatggcgctcggtctcggcgaaggcgccgagcagaacgcaccactgggccgcgcggtgatcggcgggctgctgttcgcgaccgtttcgacactgctgttcgtgccgctcgtgttcggcggcgtgcatgcgcggctggcccgccggcgcgcgcgccagaccggacactgactttcgtcccctttcgtcccctttcgtcccctttcgtcccactacccggttgaattggttgaattcatggaagagaaacatcacagcgccgtcggcatccaggtggacgaacacggcatgcacctgccgacacgcacgtcggtgtcgcgacgcggacgcatcgtcctgatcgtgatcggcgtgctgctggccgccggcgccgcgcgcacgatcgtcgtcaacgtgctgaaccgcaaccggctcgacacggtcgccgagcagaacacgcgccagtacgtgaccatcgcgcatccggtcgatgcggccaccggcggcaagctgtcgctgcccggcacgctgcgcggcttcgtcgaggcgccgatctatgcacgcgcgagcggctacgtgctgcgctggcaggccgacatcggcgcgcacgtgaagcagggccaggtgctcgccgaactcgacacgcccgagctgaaccaggaactcgcgcaggccaccgcgcagcgccagcaggcgcaagccgcgctcgcgctcgcgaagacgtcgttcgaccgcgcgcagcagttgcgccagcgcgatgccgtctcgcagcaggaactcgacgaccggcaaggcgcgttcaaccagggcaccgcgaacctcgccgcggccgacgcgaacatgcgccgcctcaccgagctgaaaggcttccagcggatcgtcgcgccgatcgacgggatcgtcacgcagcgcaacgtcgacgtcggcgatctcgtcagctccggcaatgcgggccgttcgctgttcacggtcgtgcaggccgaccggctgcgcctctacgtgcaggtgccgcaggcgtacgcgcagcaggtgaaggtcggccagcacgtgagcgtcgcacaggccgagctgccgggccggacgttcgacgggacgatcacgcgcacgtccgaggcgatcgacgtcgcgacgcgctcgctgcagatcgagatcacgctgccgaacccggacgggcggctgctgcccggcgcctacgtgcaggccacgttgccgatgacgccggtcggccgcctgcaggtgccggccaatacgttgctgttccgcgccgaaggcccgacggtcgcgacggtcgatgcgaacggccaggtgcgcctgaaacaggtgacggtcgtgcgcacgatcgggcagacgctcgaagtcgacggcccgctcacgccgaacgaccgcctcgtcacgaacccgagcgacgccctcgccaacggcgatcaggtgatcgtctcggcgccggccgcgaaaccggcatcgagcgccgcggaggcgaagtcgtgatcgcgatgcgcatccgccggcggcccgccgccgtctccgccaccgccgttgcgctcgccgccgccctcgccggctgcacggtcggtcccgactaccagcggcccgacgtcgccacgccggccgcgtggcggctcgatccggccgatgcgtactggcacccggccgcgccggcccgcgcgccgctcgacccggcatggtggaccgcgttcggcgatccgcagctcgacgcgctggaagccgaagcgctgcgcaacaaccagaacctgaaggccgtcgccgcgcgctacgaccaggcgaaggcgacgctcgcgtcggtcgcctcggcgcagtatccggccgtcggcctgaacgcgagcggccagcgcttcaagatctcggccgaccggccgcagaccaactacgcgacgcagagcgcgtcgaccgtgcagaacgacgtccaggtcggcgcgagcgtcagctacgagctcgacctgttcggccgcgtgcggcgcagcgtcgaatcggcgcaggccaccaccgaacaggcgcgcgacgatttcgcgaacgcgcgcctggtgctgaccgccgatctcgcgtcgagctatttcgcgctgcgcgaattcgacaccgagatcgacgtcgtcaagcgctcgatcgacctgcagcagaaggcgctcgactacgtgagcgcgcggcacgacctcggcgcggtgtcgggcctcgacctgcagcagcgcgcgcagctcgacgcgacgcgcacccaggcgcgctgctgctccagcagcgcgtgcaggtcgaaaccgcgatcgcgacgctggtcggcacgccggccccaccttctcgatcgcgccgcgcgtcgtgccgatcaacgcgcccgcgctgccgaccggcctgccgagcgacgtgctgcagcggcgccccgacgtcgcgtcggccgagcgcgcgatggccgccgcgaatgcgcagatcggcgtcgcgcgcgccgcgtatttcccgcgcatcacgctgtcgcccgacatcggctgggacgcgacgcgcttcgccggcctgttcaccgtcccggcgttgctgtggtcggtcggcgggtcgctcagccagccgctgttcgaaggcggcaagctgaaagccggcgtcgatttcgcgcaggccggctatgtcgccgcgcaggccaattaccggcagaccgtgctcaccgcgttccaggaggtgcagaatgcggtcaccgggttgtcggtgctcgcggaggccgcgcagcaggcctccgcggccgtcgacgacgcgcgcaagctcgtgtcgctcgcgcaggatcgctacgcgggcggcctgacgccgttcatcgacgtgctgacggccgagcagcagttgctgaccagcgaacggcaggccgtgcagatccagggccagcgcgcggcgctcgtcgtgtttctcgcgaaggcgctcggcggcggctgggacggccaggcagcaagcggcccggcgccggccgaggtcgccgcagccccggcaccggcgccagcgccccgggcccttaaccggattacgcggacaacggattcgaacatgaaagtcctgatcgtcgaagacgaaccgaaagtcgtcgaatacctcaagagcggcctgaccgaagaaggctgggtcgtcgataccgcgctcgacggcgaggacggcgcgtggaaagccgtcgaattcgactacgacgtggtcgtgctcgacgtgatgctgccgaagctcgacggcttcggcgtgctgcgtgcgttgcgcgcgcagaagcagacgcccgtcatcatgctgaccgcgcgcgaccgcgtcgacgaccgcgtgcggggcttgcgcggcggcgccgacgactacctgaccaagccgttctcgttcctcgagctgatcgaacggctgcgcgcgctgacgcgccgcgcgcgtgcaggaatcgacgctgatctcgatcggcgacctgcgggtcgacctgatcggccgccgcgcgacccgcgacggcacgcggctcgacctgaccgcacaggaattccagctgctcggcgtgctcgcgcggcgcagcggcgaggtgctgtcgaagacgaccatcgccgaactcgtgtgggacgtgaacttcgacagcaacgcgaacgtcgtcgagacggcgatcaagcgcctgcgcgcgaaactcgacggcccgttcgcggacaagctgctgcatacgatccgcggcatgggctacgtgctcgaggcgcgcgaggacggcgataccgagaggccggcatgaaacgctcgatcgtcctgcggctgtcggcgatgttcggcatcgtgtcgctgctcgtgttcacgctggtgggctgcgggctgttcgtgatgatggagcgccagctgttcgccgagctgcgcgcgacgctcgatacgcgcaccaaggtcgccgagatgatcgtgtcgcacgcgctcacgtccgaacgcgggcgcctcatgcaggaaaagctcgccgatctcgaaccgcccgacggctcgacgcgctaccaggtcgacagcacgaatccggatttccggttcggcaagcccgtcgacggcgtgcccgtcggcgcgccgttcggcgcattccagcgctacgcgctgaacgacagcagctacgacgtgatgaccaagaccgtcacggtggccggcaacggcgagcggccgacactgaggctgatcgtcgccagctcgtgcgagcgcacgcagcggatgctgcgccgcttcggctggacgctcgccgggctgatcgcgatcgcgacgatcatcacgctgctgctgagccgcgcggtggcccgcttcgggctcgcgccgctcgaccggctgtcgcaggatgcatcggccatcagcctcgcgaaccgccgccagcggctgcacacagacgcgctgccggccgagctgcgcgacctcgccacgtcgttcaacggcgcgctcgatcgcatccagcagacctacgcgcggctcgaggcgttcaacgcggacgtcgcgcacgaactgcgcacgccgatcagcatcctgatcggccagacccaggtcgcgctgaccagccgcgaccgcacggtcgagcggatgcggcagacgctgcagtcgaacctcgaggaattcgaacggctgcgcgtgatcatcaacgacatgctgttcctgtcgcgcagcgaccgcggcgaacgggcaaccgacctgaaggacgtgtcgctcgccgacgaggtgcggcgcatgctcgatttcctcgagatcccgctcgacgaggcgcagttgcacgccgaactgcacggcgacgcgcgcgcggccgtcgatccgtcgctgttccgtcgtgcgatgacgaacctgctgatcaatgcgatccagcattcgtcgcccggcgcgacgttgcacgtgacgatcacgcgccgcgacacgctcgtcgagatggccgtgtcgaaccccggcgagccgatcgatccggtgcagcgctcgcatgtgttcgaacgcttctaccggctcgaggaagcccgcgcgaacagcaaggagaaccacgggctcgggctgtcgatcgtcaaggccgtcgccgagatgcacggcggcagcgtattcgtcgcgtgttcgggcggcgtcaacacgttcggcttctcggtgtcgacggaaccctgcgcgggcggaccgctgcgcgcgggagatgcaaccgatgcaaccggcgtggtcgactccaccgattcgcggccggcgcacgcgccgcgggcgctgcactgacggcggctgcgcctgtcgacgtccggccgcctccgatcggcgcttgccggccacgaacgcggcccgggacgcattacgcgcgcggcttgccgccctgctcgcgccacgcccgcggcgacatcgcaaaccgctcgcgaaacacgcgactgaaatgcgacatgtcgttgaatccccagcgcaatgcgacatcggacacgcgcagcgacgcacattgcggattcgcgagatcctgcgcgcaccgttcgagccgcaggttccacacgtgacgcatcagcgacgtctcctcggcctcgaagagcttgttgatgtaccgcgacgaaatcccgatcgagcgctcgatcatcatcgggttcagctccggatcgtgcaggtgctcgagcacatgccgcttcacacgcgtcagtgtcaacgccttcatcctcgattgcgcgaggtcgttgcgttgcatgccccgagcgtcatcgcgatcagcgtgatcgcggtatccgacaactgccgcatctcgtcctcggtcacactgcggatctgcgacgacatctgctcgagaaacgcacgcatgacgctgccgacgccgtccccggtttgcgtcgggcacgccgtgcggtgctccatcccgacgacgagctggttcagcgtcgcgcggggaatgctgacgacgatctcgcgccacgactggccgaactgcaggtggtgaggccgtgtcgcatcgtagatcgcgaaatcccgggatgcagcgtgacgatcttgccgtcctgttcgaccgactggctgccctcgagcatcaagaccccgaaatacttgtcctcgtactcgctgcgcgcctggcgataacgccggatcacggcctgctcgctcgcgtggatttccgagattcgcatcttttcgcacttgcgctgccgcactcggccgaagaaatcggctttctgcacggccgcgatctgcacgtccgcgaacaggcgcagaatcgtctcgcgccagaattcgatacgctggctgaccgagccgtcgatcggtacctcgatggccgcgttcgtccgttcgtccagcgggctgccggacgccggaccgggtgcgtcgccgcgtgcggcgcgcgggagaggacgcatcgtcatggtcgtgccccacatgggttagcaaacacgcagccgacagcgtgcccgttcaaaagcgcattgtccaatcgatgaccgcgtacgccgcgtggccggtcgaaccggtacgcggcgcggcggcggcatgctaccgctccggacatgtcatgcgcacgtcgtccgacgccagtcggacgactgttcatacgcatacgcaacgcggtagagcgtcgcctcgtcgaaacggcgcccgaccagttgcagcccgatcggcagatcgtcggctaccccgcacggcagcgacattgccggatgcccggacacgtcgaacggcgcggtattcgcgagcatctcgaacgcccgcgtcagcgactcggacatcgcgcaaccgggctccggcagcttcgatgcgcgcatcggtacggtcggcatcagcaatacgtcatacgactgcagcgccgcgtcgtaagccgatcgcaagcgtcgcgcgaggttctggcacttcgcgtagtaacgcccgcgataccggctcgtgaagtattcgcccagcagcatcgtcaccttcacggtatccggcaactcgtcggcgcgctcgcgccagcccgcgtgatgatcgatcatgccggtcacgtacaggccgccccagttgaaaccgtggctgttgcccttcatcatctgctgcgtcgcgccctcggccgcaatcggcagccagatcgcggtgccggccgcatgcagcggcaccgacacttcgtcgacgcgcgcgcccagcttgcgcaaacggagcgcggcggcccgcacggcctcgtcgaccaccttctccgaattggcgagcccgaacgcctcgcgcaggatgccgatccgcaatcccgcgatgccgtcgcggatcgcgccgagatagtcggcgcgcggcggcaacgtccgttggcgcggatcgagcccgtcgtcgcccgcgatcacgtcgagcagcagcgcgttgtcgagcacgttgcccgtcatcggccccagatgatcgacggttgcctcgatcggcatcgcgccggtgtacggcacgagcccgtgcgtcggcttcatcccgtagatgccgcaataggcggacgggatccgcaccgagccgccctggtcgccgccgagcgccatgtcgacctcgccgctcgcgaccagcgcgccgctgcccgacgacgagccgccggacgagtgccctgccttgcgcggattgtgcaccggccccgacgcgctcgtgtgcgagccgccggaaaagcagtagtactcgcaggtcgacttgccggcgatcgtgccgccggcgtcgagcacccgcgtgacgacggtcgcatcgacatcgggcacgtagccctcgaacgtggtcgagccattgcgcatcggtacgccggcgacgcagatgttgtctttcacgaccaccgtcctgccgcgcagcttgccgtcggcggcgccgtggatcgtgctcttgcgcgcccacgcgccgtaacggttctcgtcgccttccgggcggtagccgggcgtgcgcggatacgcgacgacgggcagatagtcgggcagcgcgtcgatcgcatcgtaggcgtcgaagttcgcctgcagggcatcgtcgtattcggcgagttgccgggaatcgagatgaaagccgaagccggctgccatatcggacagttgttcgcgggtcgggcgtttgatggccatcgacgttctccagttcggtaagcggcaccgccggcccggcggtgccggcgggattcagcgggcaatggcgacggcgtcgcgcatcatcccagtgcgcggatggcagttcacgtattcgtagacctgatgcttcgcgtcgaagacggaaacctcgtgatacagccgcagtttcgacagcccggtgacgacgcggaagaaggtgacgaagatccgcaggtgcgtcggatgggattcggcccatcgttcgaggcggtcgagcgagcgccagtggccgatgttgtagctctcgtcgagcacgttgccgtcgagatcgatcgagcgcacgtagcggttgctgtagcagccgacctccgtgccgttgtcgcgcaggaagtccattccgctgcgcagcgtcggctcgatctcctcgagatacagtcggcgctcgtcgtgctcggccgcgcgccagtcctggccggagcgaatcagcgcgatgttgtcgtgcgccagcacgaccacgcggccgccgcgggctggatcgccctcgacgatgcgcaactcgccgtccgcccgcatccagtccgtctgcgagatcgggaaccggtcgcgcatcgatccccagtagccgtgctcctcgatctcgccgctgacgccgtccatgatcgcgccgacgccgggaaatcgttcgtgaacgcgtagagcgtctcgaactgctcggcgcgcggcgcgacgatttcccggaagtagccgatgccgtccgcgaggcgtgcgtcggaggcccaccattcgacgagtgcaggcgacgcaatccagcgcgcatacgcggccggatcgcgccagtagccgacggcgatcaggttctcgtaaccctggtcgtcggtgtgttgcgtcagatcgaagttgttcgggccgtcctgcacaccgaaatcggcgacgatcccgcgcaacgcggccagtgccgccgcacgcttgtcggcgccgctgtattgcacgccgaaatagcccatcacgacctggctcaggtcttcggcggcccgggcgacgtacatcgggaacggcggctggtagtcatcggcgacgcggcgcgacagcgtccgcgggcagaccaggtgtttgtcgatggcggattccatgcatgacctctctggaaagggaatcgggtgtcgaggtatcgacgtggggaaggagcgacatgcaccggccttgtcccggcgcatgcgggtggtcagaagatgtgcgcgtaacgcaggccggcgagcacactgttcttcggaccgttgcgcacgctcaggtcggtgccgagctggatttgcacctggtcggccttcgtcacgaacttcgccgcggtgatccgcaggcgcgtcgtgcgcagcgcgtcgttgttgtccgcgccgtcgacgctcgtttcaccgccccagagctgcgtgacgccgatcccgagcgacgtgcccggatcgggcatgtaacgcaccatcgcctgcgcgctgtagctcattcgctgatgcagcgtcgcgccgctcgcgccgtacgacgtgttgttgccgtaccagatcgcatcgccgacgagatcgagtgcccactgcggcgaaaagtgcttgacgtaggccgcctggaaatcgagcgaccagcggttggcgccgagattgagaccgcggttctggtcgtagctcccggtcggcgcgtagacatagaccgtcgcggcgacgacgtccttcgcttcgttcaggcggaatttcaacggtgcggtcaagatcacgtcgccgacaccgttcgtactgccaagcgcgccggcgttgccgaagctgctgatatgaccgaacggcagcaacacctgcggatcgatcgtgagcctgtcggtgagctggaacacatgcagcaggcgggcgatgccgacattcgactgcaggtcgaaatccgacgtccggtggccgttcgcgtagtaggcgttcgtcgcggaatagttgtagtacagcacgccgatcgtcgcgccgaccggatactgctcatagtcgccgggatcgacctcgaccgcgcccgcgtagtgcgatgcgacggcgatcagcgacaaaccgatccagcgcgcgattcgcttcagtttcattctgttgacgttgtccatcatgctcctcacctggttgcgcagacaccgccacgctcgacgcacgacgaacgggaaccgtcgccggatggtggaatcgcgggatgctggccgactgttgttccgccgttacatcggggatgccggcgattcgcgacatcgaacggccgtcgcttgaggatgagaataggaaggcaaaatccgcagttctgttttccggcggaacaagaaattggctgtggcggacctgcgcctccgatgtcatgcagcggtcgcaaaacgtgcgccgccgccgctgttttcgtgccgggcgccccgccaattgccgcccatctccgtgcatccgcgcgcatcggccccatgccgcgccacggggccgtctcagcacagtttccgatccgtgccggcaaagaaccgcgctttttctcttcttaccctgctcgtcgagcgtgaccgacaccacgcgtccacgccccgccacggcaataccaacgcgatggcggcggtcaacccgaaccacgacaaggaaccccacgatgagcgcgacccttctgcggaaacagcctcgacgcccggcgaacgtgcctgggcgctgtttcgcgtgatgaaagagaagaacctgatccccgacggctatatcgaaggcctgaccgagctgatgtccacgacctgggatccggccaacggcgcgcgcatcgtcgcgcgtgcgtgggtcgacccggcgtttcgcgaactgctgctgaaggacggcacggccgcgtgcgcgcagttcggctacaccggcccgcagggcgagtacatcgtcgcgctcgaagacacgcccacgctgaagaacgtgatcgtctgcagcctgtgctcatgcacgaactggccggtgctcgggctgccgcccgagtggtacaagggcttcgaatatcgtgcgcggctcgtccgcgagggccgcacggtgctgcgcgagctcggcaccgacctgcccgacgacgtcgtcgtgaaggtctgggatacgaccgccgaaagccgctacctcgtgctgcccgtacggccggccggcagcgagcacatgaccgaggaacaactgcgcacgctcgtcacgaaggacgtgctgatcggcgtggcgctgccgcgcgcgctgactccccgtttcgctctcgaccttcatctcggagatcacatatggacggctttcacgacctcggcggattccagggtttcggcccggtgccgcacacgatcaacagtctcggctacaagccggtcttcaaggaagactgggaacatctcgcgtacagcctgatgttcgtcggcgtggaccaactgaaaaattcagcgtcgacgaggtacgtcacgcggtcgaacgcatcgacgtacgccagcatgtcggcacgcgctactacgagcgctacgtgatcgcgacggcgacattgctcgtcgaaaccggcgtgctcacgcaggacgaactcgaccgcgcgctcggttcgcatttccggctcgcgaacccgccgacatccggcggccgggcggcaccgcccgactcgacgcggttcgaggtcggcgagcgtgtcgtcgttcgcgacgaatacgtcagcgggcacatccgcgcgccgggctacgttcgcggcaaggaaggcgtcgtgctgcaccggacgaccgaatcgtggcccttcccggacgcgatcggccacggcgacaccggcgccgcccatcagccgacctaccatgtcgagttccgcgtgaaggatctgtggggcgacgccgccgacgacggctacgtcgtagtcgacctgttcgaaggctacctggatcgcgcgtccgggcagagcgcatgacgacgccggggaagcaaggcgcgccggccgcccctggcccgaggattccggtcaccgtgctgtccggcttcctcggcgccgggaaaacgacgttgctgaaccacatcctgcgcaatcgcgcgggactgaaggtcgccgtgatcgtcaacgacatgagcgaagtgaacatcgacgccgacgacgtgcggcgcaacgtcgagctgcatcgaggcgaggacgaactggtcgagatgagcaacggctgcatctgctgcacgctgcgcgccgatctgctggcgcagatcagcacgctcgcgcggcagcgccgcttcgattatctgctgatcgagtcgaccggcatctcggagccgatgccggtcgcggagacgtttgcgtttctcgatcgggacggtttcagcctgagcgagctggcacggctggacacgctcgtcacggtagtcgacggcgagacgttcgaggacatgatcgcgtcggccgaaccggtcgcgcacgacgcggcgctcgcgaacgacggcaattccggtccgccgcgcaagctgtcggacctgcttctcgagcaagtcgaatacgcgaacgtgatcctcgtgagccgtctcgaccggatcggccacgcgggtttcgaccggctgcgcgcgattcttgcgtcgctgaatccatctgcgcgaatcctgccgatgcagcacggcaaagtcgatccgtcagacgtgctggatacccggcgcttcgatctgccggcgctcgtcgaatcgccgggatggatgcagcgcatgcagatcgacgaacgccctcggaatcggatgcgtacgggatcgcgtcgtggacctatcgcgaacgtgcgccgtttcatccggcacgcctgctcgcatggctgcgccgcccgtgggacaacggccggctgcttcgctgcaagggttatgtctgggctgcgcaccgctatcccgagatcgccatgctcgtgcagacgggcggcgcgttccagtggggttacgttgggcgatggtggcgattcatcccgcagtcggactggccgcacgacgactatcgccgcgatggcgtgctgaaaaatgggaggagcctgcaggggattgtcggcaggaaatcgtgttcatcgggcagtcggtcgatcacgaccggttgcgtcgcgaactcgatgcgtgcctgctgacggtcgaggaaatcgacgcgggcccggagtcgtggctgcggcttccggaagccgacgcgttcgacgcgctcgcggcggccgctcatccgtgacgtgagactcgatgccttcggttgcaacgcctgcgtccaacgactgtcgagcaccggtgagcgccgtgcccggttcggcgttgcctgaatccagacagcgccgccgagggcagttttcttcaataccggcacgcgcggcttctttagtctcgatgcgactttgacattcgcatggaggcactcaatgagcatgctggtttcgatggcggcgttcgcgctggcctcgtcgatcacacccggtcccgtcaacatcgtcgcgctcagcgcgggcgcgcgccacggtctcggcgcaagcctgcggtatgcggccggcgcgacgctcggcttcgtcgcgctgttcctgctgatcggcctcgggctgcacgcggcgctcgcgcgctggcccgtgctgacgaccgccacgcagtggtcggggatcgcgttcctgctgtacatggcgctgcggctcgccctcgacgacggccggctgtcggccgacccggacgtggccggcccgtcggcggcgtccggcgctgcgatgcagtggctcaatccgaaggcgtggctcgcgtgcgtggccgcgatgggcgcgtacgcggccgacggcgaccgcgcgcaggtctggcagttcgccgcgctgtatctcgtgatctgtttcgcgtcgatcgcttgctggggatatgccggcgcatcgctgcggcaccggctcgcgaacgcgcggaggatgcgcgtgttcaaccggctgatggcgctgctgctcgcgggcagcgcgctgtttctgctggacgtctagccggccggctcgcgggtcaggcgcttcggcgtatcgacggcgcgagcgcactccgcgctctgcgcgctgccgttcagctcgtcgcgctgcggtactggccgggcgtcgcggccgcgatccgccggaacgcgcgctggaaatgggcctggtcggcaaagcccgcgtcgagcgcgacgtcggcgatcggccggccgcggcgcagctccgtgcggccgtactgcacgcggcggtcgatcaggaacgcatgcggcgtcatgccgtagcgcgcgttgaacgcgcggatcaggtacgacggcgacaaatcggcggccgcgcagatcgcatcgagcgtgacgccctcgcggcaatgcgcggcgatgtagtcggccgcgcgcgcgagtttggcgttgtcgtccccggcgcgcgggccgggcagctcgcggtcgagcgcgccgtgcagcgccgtgaagaattcgaccgccgcgctctccttgccgagcggatcgatgccgggcgcgacgagcgtccggtagaaaccgccaaattgcgcgaacaggtcgcgccgttccgtcaacttcggcgaaaagccgtgaaaatcgcggttcggatcgcggcccagcgaatgctgcagccgcgcgagccacggcacgtcgacatagaccatccggtacgcccacgcgtccgggccgtacggattgcacgcatgcacctgttccgggtcgatgatcaccagcacgccgctcccgacgtgctcgtgcgtcgcgccgttcacgtaggtactcgtgccgccgacgatcgcgcccaccgaaaacgtgtcgtgcgtgtgcttcgcgtagcagatcgagcggccgtcgtcgacggtgcgcgcctcgatgaacggcagcgcggcatcgcgccagaacggcgacggtacgacggatcggttggcggtacggctcacgcggcgggctcccggttcggacggcgaccgcccaccgtacaagactgtgcggcgccgcgcaaccggaacgccacgcttcgatacgggattgcgccgtttcgcctaagctttgaattccgtccgccgcggcgcccgcggcggttttcgttcactcctcttccgtcacgctcatgcatatcgatctgaaaggcaagaccgcggtcgtcaccgcctccaccgccggcatcgggctcgcgattgccgaagggctcgcgcgcgccggtgcgcgcgtcgtcgtcaacggccgcagcgacgcgtcggtgcagtccgcgctcgcgcacctgcgcgcggccgtccccgacgcgggcttcgacggcatcgcggccgatctctccgatgccgcgggtgtcgcccgcatcacgcagcacacgcccgcggccgacatcctcgtcaacaacgcgggcatctacggcctgaaggcgttcttcgagatcgacgacgccgagtgggaacattacttccagatgaacgtgatgtccggcgtgcggctcgcgcggcattacctgaaggggatgatcgaacgcaatgccggccgcatcgtgttcatttcgtcggaatcgggcctgaacatcccggtcgacatgattcattacggattcacgaaaaccgcgcagctgtcgatcgcacgcggcctcgcgaagctcgcggccggcaccaacgtgaccgtcaactcggtgctgccggggccgacgatgtcggacggcgtgcgggcgctgctgaaggaaacggccgacgaaaccggccgcagcgtggaagacgtggccgtggagttcgtgcgcaaccatcgttcgagctcgatcatccagcggccggcgacgcccgaggaagtcgcgaacctggtggtctacgtgtgctcgccgcaggcttcggcgacgacgggcgccgcgttgcgggtggacggcggcgtggtcgacacgatcgcgtgacggcgggcgggcacggccgccgcgctagcgcgaagcggccttgcccggctggagcgtgcccttgcgatcggcgttcatgcacgaatcgaagccgtgttgcgtgacgatgccggccctgtcgaacacgacgaaatattcgcggtgatcgttgccgtgctcgatgaagtagttgtagcagacgccgctgccgttgcggaccatccagacgctgcgcgggttgccggccgcgcggacgacatcggcgcgcgtcgcgccgtgccgcgaggcggcccgcgcgagcggcgtgcgtgaatacgaaaatggcagccacgagtcgaaccacgcgcagccgtgcaacatcaggcagctggcggccagggacagcgtcgctgcgggacgggccatcgaaatcaatcgcatgcttgggaaaatctgctgcgccatgccggcgtgatcgaaagccccatgctactcgacctttgggtccggatcgaaaagaaatgtagagatctttatacgaatccctgcatgtcatgcccgcgcgcaagcccggtcgttgcagccccacatgcttgcacgcgcatcgaatctgccgcgccgatgcgtcaaatcggcacaacgtcgcgcatcgtcacgcgatccactcggcccacagcatcgtcagcaccgtcatcagcgcggggccgacgaacagcccgatcaggccgaacgtctcggcgccgccgaggatgccgaacagcaccagcaggaacggcagccgcgccgagctgccgatcagcaccggccgcacgaaatgctcggcgacgaacacgacgacgaaaccgagcacggccaccacgacggcccacgccgtcgcaccctgcacgaacagccagagcgccgcgccgcagaacacgatcggcgcgcagaacggcagcatcgcggcgatcgccgtgacgaggccgagcagcgccgcatgcgggacgccggccagcgcatacgcgatgccgagcagcgcacctcgccgagcccgacgacgacgagccccgtcaccgtgccgtacacggccttgaccatccggtcgatcagttccgcgccgttgggcccgaacgcgcgccgcgcgccctgcagcaatgcgcccgacagcttgtggcccgcgcgcaggatcacgaacagcgtgacgagcatgaagccgaattcgagcagcacatgcgcgagcttcgtgccgaactgccgcccgaacgcgaggaatttctcgctattgacgccgtgcatcgcgctggccgcgtgcagcggatggccgagattggcctgccaccattcggtgatctgagccgaaccgtaaggcagccggctgacgacgtccggcaacggaatgccgctgtcctggaccgacttcagccactcgcgcaggtcgtgcgcctgcccgatcgcctggacggccgcgaccgcgatcggcagcacgacgagcagcgagatcgcggccgtgatgacggtcgcgatcagcgtcggccggtcacggaacagccggtgcgattcgaagcatttgagcagcggccacatcgcgatggcgatcacgcaggcccatgcgatggcgggaatgaagtcgcggatgatccacagcgcgagcaccagcagcgccgcatacagcacgacgcgggcaacctgctgcgcgcgcggccgtgcggcggagtcgtgagacgacgggacgtgtgcgcccatggcacctctgtcgaaatgaaaaatggcggttcgcgcaggcaaccggcctgcatgaaccgccattctatccatcggcgccggatcggcgacgcgcaagatgcgcgcgccgtgtcgtcaaggcggctcaggccgccttgtcggcgatccggtagcgctcgagccagtgcgcgtacggcgcgggcagcgtccacgacggacgctcgacgccgagctgcctggccgcgtagtacggccagtgcggatcggccaggtgcgcgcgcccgaccatcacgagatcgagctgcgcttcggccaccacgcggttcgccagttgcggcgtgtcgatccccatgcggacgacaccggcagcccggcctcgcggcgcacgcgctcggcgatcggcgcgaggaacgccgggccccacggaatctgcgcggcgggcgtcgagaagccgaccgacacgctcagcatgtcgagcccttcccgcttcatccgctgcgtgagcgcgatcgactcggcgagcgtctcttcgtcgcggccgtcgtattcgatcacgcccaggcgcgcggtcagcggcaggtgctcgggccagaccttgcgcacggccgcgagcgtgtcgacgaggaagcggccgcgattctcggccgagccgccatattcgtcggtgcggtagttcgaatgcaccgagaagaagctctggccgagataaccgtgcgcaaagtgcaactcgagccattcgaagccgagatcgcgcgcacgcttcgccgatgcgacgaaatcggcctgcacgcgggcgatgtcgtcgtgcgtcatttcacgcggcactttcggcaggtgcgcgccgaacggcacggccgacggggcgatggtctgccagccgcgcggatcgccgtcggcgatatggtcgtcgccttcccacgggcggttcgcgctcgccttgcggcccgcgtgcgcgatctggatgccgggcaccgcgccggcggccttgatcgccgcgaccgacggcgcgaacgcttcggcctgcgcatcggtccacagccccgcgcaacccggcgtgatgcgcccttccggcgacacggccgtcgcctcggcgatcacgaggcccgcgccgccgcgcgcgatgccggccagatgcacgtgatgccagtcgttgacgacgccgtcctcggcgacgtactggcacatcggcggcaccgcgatgcggttgcgcagcgtgacatccttgagtttgaacggttcgaacagggcagacatccacggctcctttgcttggttctgcaaaacgacgggaaacgcgccgtgcggtgcgcacgacggaacgattcgggccgtcgccggacggcttgcgcccggcgacggatacggtgcggcgccggcccggccggcgccatcggctcaacggcggccgagttgcacgagcagcgcctcggcggcgggcgccgacgacgcgggttctgcccgtgatcagcagcccgtcggtgacgatatgcggcgcccagtcggcgctgcgttcgaattgcgcgccgttggtcttcagcatgtcctcgacgaggaacggcacgacttccgtcagttcgacggccgcttcctcgctgttggtgaagcccgtcacgcgcttgccgcgcacgaccgattcgccggtctgcggattcttcacgtgacgcagcacgcccggcgcgtggcagacggccgccaccggcttgccggccgccagcgcgcgctcgatcaggccgatcgaatgcaaatcctcggcgagatcccacagcgggccgtggccgcccgggtagaacacggcgtcgtagtcgtcaacggacacgtcggccagcttgcgcgtcgacgccagttcggccttggccgccccatcggcttcgaagcggcgcgtcgcgtcggtctgggcggccggatcgctgcttttcgggtcgagcggcggctggccgcccttcggcgacgcgagcgtcagctcgacgcccgcatccttgaacacgtagtacggcgcggccagttcctcgagccagaagccggtcttcttgccggtgtcgccgagcgtgtcgtgcgaggtcaggacaaccagaatcttcatgatcggacactccttcgaaaagttaacgggaacggggccgcatgatccagaaaaccggccggcgcggcgcgccgcctgtccgttagtcagctgtgacgcgtcatcgtgcgacccgcgtatccgaatgcggcatgcgcctattagaccagtcgtctagaacattcgaaaataaaacgacggcgtctcgccgcgctaccagcaccacggcgcgagatggcattttcgcgccttgcttgcctgcgccacggacgtcgccgcattcacgaggacggatgatagtcgtggattagaccggtcgtctagtagtcggacaatcatccctgccgtcgtcatggcctttctcgagggcgcgatccgtcggtgcccgcaggtactcgcgcccctcgccttcaccgcgccggctggtcgcgcaacggaccgtcggtgtcgcccgcctcgattgccggggcctcgagacggtgctcgcgcacgccgtcgccgagcaggcgcagcatcagttccgcgagcgagcgccccgatgcgtggccggtcggctgtacgaccgccgtcacgcgatacgggtgcgcgaggcccggcggcacgccgtcgtagacgatcagcgacatgtcctcgcccaggcgcagcccgctgtccacgagcgcccgaaacgcgccgccgcccgcgatattgttgtcgaccagcagcgccgtcggccgctcggcgcgcgcgagcagcgcccgcaccgcctgcaacccgccgtcatgcgtgaacgggcactcgacgagcagcgccggatccggctcgatgccggcttcgcgcagtgccgacagataacctgcacggcgctgcgcggcgaaattcagggcaagcggcgcgctgatcatcgcaatgcgccggtgcccgaaacccgtcagccggcgcaccgcgtcccgcgcgcccgcttcgttgtcgaagtcgaaccacgcgtacggctcggccatccgggtccggccgtacgccacgtacggaaacgcgctcgcctgcaggtacgcgatgcgcggatcgtcgaccagcgttcgcgcgacgatcaggccgtcgacgagtttgccttcgacgatgcgccgataggtgtccagttccgcgttcggccgcgccgacgcgatgatgaaatcgagattgcgttccgcgagccgctcggtgatgcccgcgacgacctcgccgaaacgcggatcgccgagatcgcccgcgccgaacggataaacgatcccgatcatgtcggcccgaccggtcgccagccggcgcgcggtcgggtccgccacatagcccatttcccgtgcagctcgcgcgacgcgttcgcgcgtcgcctcgctgacgtcgtcgtagccgttcagcgcacggctgaccgtcgtccgcgacagcccgagcgcgtccgacagcgccttcagattcaccttcaccgtcactcctcgcattcgccgatccgcccggccgcccgaacacagggatgcaccggccgggtaattatttccaattggtaacgattaccgtcaattaaatatcttttgcgttccaaaccggtttgaaatagcatccaaaccggtttggacatcgatgcccactcagccgttcactttgacctttccaggaaacgacgacgagatgacatactttcccttttccgcccgacgacgaccaaacgtttgctcctcgctggcggcgcacttgccgccttcgcgtccgtcgcgcacgcgcagtccagcggcacgggcgcgcccatgcccacgccccatacgcagcaggcctacgatcccgaaggcaacttcacgatgcgctggacgcgtgcggacatccgccagatcgtcgcgcagtcgcacaccgccggcgccgacaagaactcgctgccgcaagcgctgacgatgccggacatcccgcaggatttcccgctgatcaactcgaacgtgtgggtatgggacacgtggccgctggccgacctgcgcgcgaaccagctcagctacaagggctgggaggtgatcttctcgctcaccgccgatccgcacgcgggctacacgttcgacgaccgtcacgtccacgcccgcatcggcttcttctatcgccgcgcgggcatccccgcgtcgcagcgccccgccaacggcggctggacctggggcggccacctgttcccggacggcgcgagcgccagggtattcggcaccgcaccgatgaccaacaacgccgaatggtccggctccgcgcgcctcacgaacggcagcaacgtcagcctgtactacaccgcgacgtcgttcaaccgctcggcgcccggcggcgcggacatcacgccgccgcaggcgatcatcacgcgcgccgacggcaacatccacgccgacgacaagcacgtgtggttcaccggcttcggcgatcacaaggcgctgctgcaaccggacggcaactactaccagaccggccagcagaacacctacttctcgttccgcgatccgttcgtgttcaccgatcccgcgcacccgggcaagacctacatggtcttcgaaggcaatacgggcggccagcgcggcgcacgcacctgcaccgaggccgatctcggctacgcgccgaacgatccgtacaaggaagatctcaacgcggtgatgaattcgggcgcagtgtatcaaaggccaatgtcggcctggcggtcgcgacgaacccgcaattgaccgaatggaagttcctgccgccgatcctgtcggcgaactgcgtcgacgaccagaccgagcgcccgcagatctacctgaaggacggcaagtactacctgttcacgatcagccaccgcacgacgatggcggccggcgtcgacggcccggacggcgtgtacggtttcgtcggcaacggcatccgcagcgacttcctgccgctgaacggcggcagcggcctcgtgctcggcaacccgaccgacttctccgcgccggccggtgcaccgtattcgcaggatcccaaccagaacccgcgcgaattccagtcgtattcgcactacgtgatgccgggcgggctcgtcgagtcgttcatcgatgcgatcggcccgcgtcgcggcggcacgctcgcgccgacggtgaaggtcggcatcaacggaacgtcgacggcggtcgatcgcacgtatggccgcggcgggctcggcggctacggcgacattccggcgaacctgcccgcgacgggcgacggccacaacccgtgaagccgggataaccaacaataacgatcatcgataaaggcacggggttaggaggcgcatatcgcgcgtgtcgcgtgcgcgcctccactttttccttccatccattgcgcgcaccgccgtcgaaagcggcaggcgcccttctttcccgcctcgcacggcgaagcacgacactccgcatgatatcgacgtcttttcgcttttccgcccggatcgcccgattgctgctcgcctgcgtggcctgtacccaggtcgctgccgcgccttgccacgcgccggctgacgacggcaccccgcaatggcgacccgcgctccattacacgccgcagcgcaactggatgaacgatccgaacgggctcgtctacgacaacggacgctatcacctgttctaccaatacaatccgctcggcaacgactggggcaacatgtcgtggggccacgcgacgagcaccgatctcgtccactggcgcgagcagccggtcgcgatgcgcgcgaacgcgacggaggaaatcttctccggctcgatcgtcgccgacaccctcaatacgtccggcctgggcacgcccggccactcgccgctcgtcgcgctttatacgagcgtgtacaaggcgggctccggccacgcgccgggcattcaggcgcagtcgctcgcgtacagcctcgatcacggcacgacgtggcaaccttacgcacgcaatccggtgctgacgctcgacccggaatcgaagcaatttcgcgatccgaaagtgtcgtggtatgcgccgggcggctactggctgatgacgacggtcgtcgccgatgcgcacgtcgtgaagctctatcgctcggacgacctgatccactggaatttcctgagcgatttcacgcggccgggcgtgccgcacgacggcgcgctgtgggaaatgcccgacctcgtgccgctgccgctcgacggcgaccccgcacaaacacggtgggtcatgatcgtcaacgtcaacccgtggtcgatcgccggcggctcgggcgcgatgtatttcgtcggccacttcgacggccgcacgtttacgccggatcgcgtcgcccccgccggttccgatcccgcgcaattccactgggtcgaccacggcgcggatttctacgcagccggcaccttctcggcgcgcccggctcacggccggtcgcgatcgcgtggatgagcaactgggattacgcggcgaaagtgccgaccgcgccgtggcgcggcgcgatgaccctgccgcgtgaactcgctgaaaacgatcgacggcgaaccgacgctcgtcgtcgcgccggccgccgcgttcgacgcatgggcggacggccggcccgccgtgcacgaaggcgacctcacggtcgactccgcgacacgcgcgctgtcgcccgcgacgcgcggcgccgtccagcgcatcacggtcacgctcgagccgcggcacgcggcgcgtgccggcctgatcgtccggcgctcggcggacggctcggtcggcacccggatcgtgtacgacaccgtgaagcgcacgctgacgctcgaccgctcccgctccggcgaagcgaatttcgccggcacgttcagcggcgaacacatcgtggacctgccgctcgagcacgggcggctgcggctcgagatcgtcgtcgatcgcggctcggtcgaagtgttcgcgaacggcggccgcgtggcgctcaccgacctgatcttcccgccgcccgacgcggaccgcgtcgccgtattcgccgagcacggccgcgcgacgttctccgggctcacggtgacgcagctcgaagccggcggcgacaggcatggcgcctgtgcggcgcgatagatgcaatcggtccgccggtaacgagggctgtccgcccggcgcaacgccgggcggttgcagccgccggggcctcgccgatcagagcaagcccatcccgcccgacgcgatgatctccgcgccgacaatgaacgcggattccggcgcgctgaggtgcagcaccgtcgacgcgatctcgtccggcgtgccgaaccggccgatcggaacgaggcccttgatcttgtcggccgtctcgtcgagcgtggccgcgtcgagcccgagcttgccgtagagcggcgtctgcacgggccccgggctcacgacgttcacgcgcacgccgtgcggcagcagttccgtcgacagcgtcttcgcgaacgaattgacggccgccttgctcgccgcgtacaccgacgagccgggcatcccgatgtgcgcgttgatcgagccgttgatcacgatcgacgcgccgcggttcagcagcggcaccagcgactggatctggaaatacgcgcccttcacgttggtgttgaacacgagatcccacatggcctcgtcgctgtcggcgaacggcgcgagtttcgcgacgcccgcgttgatgaacacggcgtcgagccgcgcccccgccgacgcgatcgcatcggccagcgcgcgggccgacgcgacgctgccggcctcgttgcggatcgcgagcgcatccgtgccgagcgtttgccgcgcggcctcgagcgtctgcgcatcgcgcccggtgatgatgacccgcgcgccttcggccgcgaatgccctggcggccgccaggccgatgccgctgttgccgcccgtgacgaggaccgtctttccttcgaagcgttgcatgatgttctcctgtgaaccggtgagttgaccgtggacacaggatgcgcgccgcgcccggccttgccgtacgacgggcgcgacgaacacgttcgaattcgtcgaacgtgtttgcgcgggcgggttcggtcgcgctgttccgcgccgcgtcagccggccacgtcgatcccgtcgagcagccgctgcgcgagcctcggttcgcgcaattgctcgagccaccattgcagcgcccggccgtcccggtcgccgtgccacgcgacatacagccggttcggctcgcgcggatcggccgtctgtctttccacgagctcgccgcgcgccagcagcgacgccacgcgccggcgcggcacccagccgacgccgagcccgtcgcgctgcgcgaggatcttcgcgcgcatcgacggcaccgccagcacggcctgcccgccgagcaagccatacgcgcggccggccgcgcgccgcgacgaatcggcgacgacgaccgcccggtgcgcgccgatcgcatctcgcgtcaatgcgccgctcacggcggccagcggatggcgcggcgataccgcgaacacccactcgatcgcccccagctcgaaccacttgaagccgggaatcgccggcggctcgttggtcgcgccgaccaccaggtccgcacggccgtcgcgcagcgcttcccaggtaccgccgagcacttcgtgcgtgaaacgcaacgacacgcccgaatcgagcgcatcgaacgcgtggacgacgggcaacagcgtgtcgaactccagcacctcgtcgctgacgatccacagccggtcttcccagccgctcgcgacctgccgcacgcgctgcgtcagccgcgcgacgtccagcgccagccgcgccgcctcgtcggtcagcaactgtccggccggcgtgagctgccggtagccgcgccggtcgaacagcagcgcgtcgaagcgcgtttcgagctggcgcgccgcgtgcgataccgtcgacggcgccttgccgagccgcgcggccgcccgcgacaggctgccggtggcgcggatcgcgtcgagcagcgcaagttcgtcttcggacagcatggggtggctccggtgtggggttgtcgtggatcgtaaggcagcggcgggccaaggtcaatcgggcgatgcgggccggtcgtgccgatcgtgccggtcacgcgcgtatcccgcccggcctgttcggccggcctccgcgcgattccttgcgctccggcggccggtacaggcattccgccacgccgccacgcaacccgcaccatgccgccgcgaccggcttccggtatgctggttgactcgaaatcatggcaaatgaggtaaccactgcgatggacatcgcgatccgcatcgaaggccgtcacgacctgacggggcagatcttccggcaactgcgcaccgcgatcgtcgacgggcgcctcgccggcggcgcgcggctgccgtcgacgcgcgacctcgcgaaacagctcggcgtctcgcgcaagacgacgctcgacgcgttcgagcgcctggtggccgagggctacctgaatacccgcgcgggcgacggcacgttcgtcgccgacggcctcgcgcgcgtgccgcacgccgcgtccatgtcggcgccgtcgctcgtcgacggcacgccgcgcgtcgacgcggtcgatgcccgcgcactgtggaacgacctgcccgacgcgctcgcgatgcccatacagcacgatgcgcccggcttcgacttccgcggcggcgtgaccgacaagacgctgttcccgttcgacgcgtggcggcgctgcctgcatcacgcgctgcgccagcagatgcgcggccccgcccagtatcacgacccggccggcgatccgcagttgcgcggggcgatcgcgcgttacgtcgcgttcagccgcgcggtcgcgtgcggctgggacgatgtgctcgtcacgcaaggcgcgcaacaggcgctcgacctgatcgcccgcgtcgtcgtgcggcccggcgatgtggtcgcggtcgaagatcccggctatccgcccgcgcgtgccgcgttcgcgtcgctcggtgcgacggtgatcggcgtgccggtcgacgcgcacggcctggtcacggaacggttgcccgacgacgcgcgcctcgtctacgtgacgccgtcgcatcagttcccgctcgggatgccgatgacgctggaccggcgcgtcgcgctgctcgaatgggcgcagcgccgccgcgccgtgatcatcgaggacgattacgacggcgagttccgcttcgagggccggccggtggagtcgctgaagagcctcgaccgcacgggcctcgtcgcgtatgtcggcaccttctcgaagacgatctttccggaactgcggatcggctacgcgattccgccgcgcgcgctgcgcggcgcgctggccaaggcgaaacagatcgtcgactggcacacctgcacgctgacgcaggcggcactcgcccgcttcatgctcgaaggcgacttcgcacggcacctgaagcgcgtgcagaagcactacgacgcgcgtcgcaagatgctgatcgcgcatctgcgcggcgaactcgcgccttggttcgacgcgatcgtgccgaccgccggcatccacctcgccgcccgcctgaagccggggctcgacgaggcggcacttgtccgcgccgcccgcgcgcaggacatcggcctgtacggcatctcggcattccacgtcggcgtgccggtcagtgcggggctgctgttcggctatggcgggatcgacgcgctgcgcatcgacacggcgcttgcgaagctcgccggcctgctgggttcgggcagcatcggcggcccggcactggttacctgaattttccagaaattggccattcaagcaggccagcttgagacctaaagtgggtcctgtcgcgccaccgtgcgctccaaccgaaaaaggacctgccatgcaaccgcgcctgaacttctataccgccagcccgaacgccatcaaggtgatgcgcaacgccgaggacttcatcgcgaaaagctcgatcgagaagccgctcgccgaactcgtccgcctgcgcgcgtcgcagatcaacggctgcgcgttctgcgtcgacatgcacacgaccgacgcacgcaaggacggcgaaaccgaccgccgtctcgcgaccgtcgtcgtgtggcgcgaaacgccgttcttcaccgagcgcgaacgcgcagcgctggaatggaccgaggcgctgacgctggtggccgacaaccacgtgcccgacgccgtctgggaggccgtgaagccgcatttcaccgacgaggagctgttcgacctgtcgatgctgatcgcgacgatcaacacgtggaaccgcttcgcgatcgcgttccgcaagatgcccgagtaaggagatgacgatgacgtacgccacgctccgtcgcgccgccctcggcgcatggctcgcggccgcgctgctgccggccgccgcccatgcgcacgacaccggcgacaacgtgcacacgatcatgcagcaggccgtgcccgaagcgcccggcaagctcgcggtcgtcgcgaccgtcgactatgcgcccggccaggcgtcggaagcccaccggcacctcggctcggtgttcgcggtcgtgtcgaaaggcgaagtgctgtcgcaggtgaacggcggcccgctgcaccgctaccgcgccggcgaaggctggtacgaggcgcccggctcgcgccaccaggtgtcgcgcaacgcgagcgcgaccgaacccgcgcagatcgtcgtgttcgggctgaccggcgaacacgtgccgctgacgtcgccgatcgatcagtaagcgcttgccggggcgcgtgccgttgtcgaggcacgtgcgcccgctgcgcgaccgggttcgccgccgtttcgcttactgagccccgccgctctccgccggttttcctcggcgtttctctgccgtttctccgccgcttccccgccgtttccgcattagccgctccctacactccgctacccgcttgccgcaccgcgccgcgccacatcccggcccgcccgcccgcgcccccgttcgacgctcgcctgatctcgatcaacccggtcgaaaacccttccttgaaattaactaactcatcaattagcgtcgatttcatgaacgcgaaatccaccgtcgccaggccgcgcgggcgccgcccgtcggtcgacgatttcgacctgcgcgaccacatgctcgacgtcgcgatgcagctgttcgccgagcgcggcatcgccgcgacgaccgtcgcgcagatcgccaccgcagcaggcgtcacgtcggcgatggtccactactacttcacgaatcgcgagcggttgctcgacgcgatcgtcgaggaacggctcgcacaggcgatcgcgttcgtgtggcgaccgaccgagccgcggatcgacgacgatccgttcgcgctcgtcggcgaactcgtcgaccgcttcttcgacgtcacgcaccgcatgccgtggctgccgtcgatctggctgcgcgagatcgtccacgaaggcgggctgctgcgcgaacggatggtccggcgcattccgctcgatcatgtcgggcgcttcgccgaacgcatccgcggcgcgcagcaggccggcacgctgaacgccgcgctcgaacccgcgttcctgttccattcgatcgtcgcgctggtgatgctgccgctcgcgaccgcgaaactgtggcaaagcgcgcgcggcatgccgccgatcgaccgcgacgtgctgcaccggcacgtccgcgcgctgctcggttccggaatgcagccgcccgcccccgcgcgtcgcacacgggcccgctcgccacggaggccgtcatgaagccgccccgcgcactgccgctggcgacggttgccgcggtcgccgcaatcgccgtgctcgccggctgcggacgtccggccgacaacggcacgacctaccagggctacgtcgaaggcgaattcgtgtacctgtcgtcgtcgcaatcgggcacgctgacgcagctgccggtcgcgcgcggccagactctcgccgccggcgcgccggccttctcgctcgaggccgtcagcgaaaccgccgcgctgttgcaggcgcagcaccagctcgcggccgcccgcgcgcagcttgccgacctgcagacgggcaagcgcccgccggaaatcgcggtcacgcaggcgcagctcgcccaggccaccgcgcaggccgcgcgggccgccgcgcaactggcgcgcgacgaacgccagtacgcggccggcggcctgtcgaagcagcagctcgacgattcgcgcacgtcggcgcaaaccaccgccgcgcagatgcgcgaactgcagaaacaggtcgacgtcgcgcgcctgccgggccgcgcgcagcaggtcgccgcgcaggccgcgcaggtcgacgccgcgcaggcggctgtggccgaagcgcagtggaagctcgaccagaagcgcgtcgccgcccccgctgccgggcgcgtgtacgacacgctgtaccgtgtcggcgaatgggtgcaggccggcaatccggtcgtgcagatgctgccgccgcaaaacctgaaggtgcgcttcttcgtgcccgaggccgccatcgcatcgctcgcaccggggcgcgccgtcgcgatccactgcgacggctatgcggccgacgtgcccgcgcacatcacctacgtgtcgagcgaggccgaatacacgccgcccgtgatctacagcaacgagagccggaccaagctcgtgttcatgatcgaggcgcgcccggccgtggccgacgcgccgaagctgcatccgggccagcccgtcgccgtgagggtgccgtgaacgcgccctccgccccgtacgcgatcgacgtcgttcgcctgaacaagcgtttcggcgacaagcatgtcgtgaaggacgtgtcgctgcgcgtcgcgcgcggcgagatcttcggctttcttgggccgaacggcagcggcaagaccacgtcgatccggatgatgtgcgggttgctcacgcccgactcgggcagcggcacctgcctcggctacgacatcgtgcgcgacagcgcgcagatcaagcggcgcgtcggctacatgacgcagcgcttctcgtactgggaagacctgtcgatccgcgagaacctcgatttcgtcgcgcgcgtgtacgggatgcccgaccgcaaggcggccgtcgcgcgcgcactcgacgggctcggcctcgcgagccgcgccgaccagctcacgggcgcgctgtcgggcggctggaagcagcgcctcgcgctggccgcctgcatgctgcacgagccggccctgctgctgctcgacgagcccacggccggcgtcgacccggccgcgcgccgcgacttctgggaagaactgcaccggctggccgcccaggggatctcggtgctcgtcagcacgcactacatggacgaagccgaacgctgccacaagctcgcgtacatcgcgtacggcgagctgctcgcgcagggcacgtcggcggagatcgtcgcgtcgcaggggctcgcgacccgcgcgatcaccggcggccacctggccgaattgtccgcgcgactgcgcacgatgccgggcgtcgaccagacggtcgtgttcggttcggcgctgcacgtgagcggccgcgatcgcgcgcggctcgacgcgacgctcgcgcaggtcgcggcgcaggccggcgggcccgccgcgctgcaggtcgcgccgatcgacaccggcctcgaggacgtgttcatctacatgatgggccgcgcatccgcgccgcccggcggagcgtcgtcatgaacgcgtgggcgcgcttgcgcgatgcgttctcggtcgcgcgctggtggagcatcgtgctgaaggaattcctgcagctgcgccgcgaccgcgtgacgttcgcgatgatcgtcggcgtgccgatcatccagctctcgctgttcggcttcgcgatcaacaccgatccgaagcacctgccgaccgcggtgattgtcgccgacacgagcccgttcgcgcggagcttcgtcgccgcgatgcgcaactccgcgtacttcgatatcgtcgggacgctgcccgacgaagcggccggccagcgtgcgctcgcgcgcggcgacgtgctgttcgtattgaacgtgccggccgatttctcgcgccggctgctgcgcggcgaacgtccgtcgctgctcgtcgaggcggacgcgaccgatcccgtcgcaaccgcgtcggcgatcggcgcgctcgccggcctcgtgcagccggtcgcggacaaggacctgaccggcccgctcgcgcacctgaacggccgtccggccgccttcgacgtcgtgctgcaccggctctacaaccccgagggcatcacgcagtacaacgtcgtaccgggcctgatgggcgtgatcctgacgatgacgatggtgatgatgacgggcctcgcgatcacgcgcgaacgcgagcgcggcacgatggagaacctgctcgcgacgcccgtgcggccactcgaggtgatgacgggcaagatcgtcccgtacgtgctgatcgggctgatccaggtgtcgatcattctcgcggccgcccgcttcgtgttcgaggtgccgttcgtcggcggcgcgttcgcgatctacctgtccgcgctgctgttcatcgccgcgaacctgaccgtcggcatcacgttgtcgtcgctcgcgcagaaccagttgcaggcgatgcagctcgcggtgttctacttcctgccgaacatcctgctgtcgggcttcatgttcccgttcgccgggatgccgaagtgggcgcagttcatcggcaacctgctgccgctcacctacttcaaccgcctcgtgcgcggcatcctgctgaaagggaacggctggaacgacctgtggccatccgtgtggccggtcgcgctgttcaccgtcgtcgtgatgggcatcgcgttgcgcttctaccggcgcacgctcgactaggcgccgcacgatgaaaccggcttcgcgtcgccccctccacgccacccgctgctgcacgctggccgctgccgcgctgctcgtcgccggatgcgcggtcgggccggatttccacgctccggatgcgcccgccacgcagcgctacacgcgcggcgaactgccggcgacgacggcagccgccggcccgacaggcgatggccagacgttcgcatcggccgaacacactccgcagcactggtggacgcagttcggctccgaaccgctgaaccggctcgtcgataccgcgtggcgcaacagcccgacgcttgccgaagcccgcgcgcggctcgacgaagcgcgccagaaccatgcggccgaagccggtgcgacgatgttgccgaaagtcgatgcgagcctgtccgcgacgcgcgagcaggtcgacacgaccgcgttcggcctgccggccagcgtgccgagcccggggccgttcacgctttatgacgcgtcggtgagcgtgtcgtacgtgctcgacgtgttcggcggcaaccggcgcgcgctcgaggcgctgcgcgcgcaggtcgactaccaggcctattcgctcgacgccgcgcgcctgacgctcgcgggtaacgtcgtcgccaccgcgatcctgcgcgcgtcgctcgcgcagcaggtcgcgctcacgcaacagctgctcgacgcgcagacgcggcagttgcgcatcgtcgaagcgcgtttcgctgccggtggcgtatcgcaggccgatgtgcatgcgcagcgcgcgttgctcgcgcagacgcaggcgtcgctgccgccgctcgcgacccgcctcgcgcagtccggccaccggctcgcgatcctgctcggcgcgccgcccgccgacgcgatgctgcccgacctcacgctggatgcgctcgcgctgcctcgcacgctgcccgtcgcgctgccgtcgacgctcgcacgcgaacggcccgacatccgcgccgccgaagccgtgctgcaccaggcgagcgcgaacgtcggcgtggccaccgcgaacctgtatccgcgtttttcggtttcggcggggatcggctcggagcgcacgcgcatcgcggatatcgtgagcggactcaacgtgtggaacgtcggcctcggcctcacgcaaccgctctttcacggcggcgaactgcgcgcgaagaaacgggcggccgaagcggcgtacgacgccgcgttcgcgagttaccgggaaaccgtgctcgaggcgctgcagcaggtggccgacgcgatgcgcgcggtcgagcacgacgctgccgcatggcaggctcgggacacggcggcacgggaagcggcggccggcaatacgattgccggcgaccgttacgcggcgggcgggatcagcacgttcgacctgctcgatgcacagcggcaggcactgcagacggcgctcgaccgtacgcgcgcacaggccgaccggcttgccgatacggcggcgctgtttcaggcgctggcgggaagctggacgaacgacgcggcggagtgagtgcgcggtgcagggtcaatgcggcgatcgaagcggagcgaccgcgcgatgcgggtttgacccagcgatagaaacggagcgaccggatgcgggcttgacgcagcgatagaagcggaatgacggcgcgatgcgtgctcgacgcaacgaccgcggcgcgacattcgcccaaatcgcgcgggcatgaaaaaccggcccgaaggccggttttcataccgcatgccgcaagcggcgctcgcgcgccgcgcgacatcagaagcggtggatcatgccgacgccgacgccgatctggttctgcttcgaacctgcgcccacgccgtcgccgatcgacgtcgttgcagcgatgatcttgccgccgttcagcgtgttgccgctcgcgtgctggtacgcctcaaccgcgtacaggcccgtgcgcttcgacaggctgtaatactgcgacaccgtgacctggtggtacttggccgagctcgtgatgccgttcgactgcgttgccgccgtgtacgagtagcctgccgcgaagtcccactgagcgaccggcttccagtgcagcacggcgccagccgtgttgaagatcgccgtgttcttgaaacccgaacccgtgcccggaatgtattgaacattcgagtacgacgccgaaatgtcccacgccggcgagaactggtagccagccgtgacggccagtcgctgttgcgactgcgcgaactggtagccattgttgatcgacgaaactgccggctcgacaccgttggtgccggctgcgttcaggccgttctgcaccgtcgagttcgcgccccacgcgccgccgccgagcgtcgagttgttgactcgctggtagccgaccgcgatgcctgccgggccgttcaggtactggatcgccgcgctccacgtcgagccgcggttcgtcgcgcctgcgacgccgccgaacgagtacgaaccgccgaccgtgaagccgtagaacttcggcgacatgtagacgagcgagttgttcgcgcggtagctggtatccagcgaatcgatatcacccgggtgcgcgccgtagtaaccggtcagccaggtcgtcgggctgtacggcgacagcagcgtgtagtacgcggtgtactggcggccggccgtcagcgtaccgtacgtattgttggtcaggccaacccacgcctgacgcgtgaagatgccgttggtccattgcgacgaaccgttagccgtgttgacgccggcttccaactggaaaatcgccttcgtgccgccgccgagatcttcgctgcccttcaggccgaagcggctgcctgcccacacgccggtggacatctgcaccttcgagtgaccacccgtggtcgcgccgactgccgacgagttgttttggtatgcgataccgttatcgacgataccgtacagggtcacgctgctctgtgcgtgggcggcggtagcggctgcaaggcccgctgccgtcatggcgaaagcgacgcgctttttcattgattctccgtcctcaaagaatgatttcttttctggtgtggttttatgactgacacatgtgcgagtacatgccgacgcgattctgacggattaccaatcatttcccaacatgtgcagtcggtcatcgtatgatcgacgcaacgcacgggttcaccaagcagttacataacacctgaaaacgcttacgcggcgggcttttccggcatttcccggtgaaaaccctagctttacatttttacgggtgcaacacgaccgtcggatgttgtcagatgccttcggcgaaatacatcttacaaatgcgcgaccgcggctgacgccgcgattcacgccgccgcgaaggatcgctgacgttcatgacacccacgtttcgcgaaacgaaataatgaaaacgtttttagacgatgcgggagagctggcccggcgaacgcgggccgagggcgacgccggcacctgtcgcgccggcatcgttcggtgggtgtcagcgtgtgaccggctgcgcgagatgcgcgctcacggcatcggagagcgcggtcatgcgcgcgcgaatcgccgtgttcgagccgaccagcgcgagcgacgacgccatgatccggtagacgcgctttctcggcaccttggccggcttcgccggatcgagccacgcgtcatgaccggccagcagctcgagcgtttcgaggccgatcatgatcggccacaggcatgccagccgcagccgcacgaagcggcgcgggatcgcaacggtatacaggcacgcgtcgcgatactggtccagcgtcacgcgcagcaggtcgaccagcacgccgcgcgcgcgcgacgcatcgggcaacatcaggtcggcgacgctcagcccgtgcgcgcccagcacatcgtcgggcaggtagcagcggccgatgcgcaggtccttcgcgcagtcgcgcaggatgttggtcatctgcagcgccttgccgaagcggatgcccttctcgaccatgtccggcaggttccagccgcgcgcggccggcgtgtgcatgcccgtcatgtcggtccagaactcgcccacgcagccggcgacgagatacgtgtagcggtcgagttcgtcgcgcgtccgcagcgacgcgacccgccccgattgctcgtcggggaacgtgcgcaggtcgaataccatccccgccgtcagcgtcgcgacgaccttgcggatcgacgcgcgatcggcgtccggctgcgcgcgcagcagcgcgagcatcggctccatcgaaccgagcagcacgtgctcgtgcgaatcggtctgcatccgcgtcacgtcctcgagcgcacgcgacagcgcgacgccgtcgccgagttgctcgaccgcatcgcgcagctcggtcagcaatgccgcccggcgatcgggcgcgacgagcgccgtatcggcgatcgtgtcggcggcgcgcgcgagcaggtacgcgaggccgaccgggtcgcgcatgccgtcgggcagcacgcgcagcgtcaggtagaaggagcgggaaacgttcttcagcaggtcgccgagcaggtaggcggaatcggttcgagtcgtcatgggtcgggaaaatcggccggcgcgggtcccggacgcacaccggcgccgggcgcccgcgccggcccgcgagtcgccgcatcgtcgcgccaggcgggcgtccggcccggcacggcgatgcaaaattcccgcaagtttagtgcatccggcgcacggcctgcctgggacggccggaatgcgtcgcccgtcgggccgccgtcaaccgccccgccgcgcatatcgcgccccgaaaacaagaaacggaaaggccggagtaatacatatgtaattattcggtgcgacgatcgcgtcccatccgactccgtgcgacacggcacgacagccgcaccgccggagcgaccgcccctttccgactctcgtttcgaaggttcaccgacatgctcttcaagcgcccgacctccctgcgctacgtcccgttcgcctgtgccgccgcattcctgctcgccgcgtgcggcggcgacgacgacgtcgcgtccgatcccacccagccgatttccgcgaagatccaggtggtcggccatcgcggcgcgagcgcgctgcgccccgaacacacgctggcgtcgtaccgcaaggcgatcgaggacggcgcggacgtgatcgagcccgatctcgtgtcgacgcgcgacggcgtgctcgtcgcgcgccacgagaacgagatctcgggcacgacgaacgtgtccgcgctgccgcagttcgcgagccgcaaggcgaccaagacgatcgacggcgcgcagctgaccggctggttcaccgaggatttctcgctcgccgagctgaagacgctgcgcgcccgcgagcgcattccgcaggtccgccccgcgaacaccgcgtacaacgatcagttcgagattccgacgttcgacgaaatcgtcgcgctcgcgaagcagatgtccgcacagaccggccgcacgatccacctgtatccggaaaccaagcacccgacctacttccagtcgatcggcctgccgctcgaggaccgcctcgtcgatgcactgctgaaggattcgtacacggcccgcaccgcgaccgtctacatccagtcgttcgaggtcgcgaacctgaaggcgatccgcaaccggatcaagtcgagccagccgaactggaagctcgtgcagctgatggacgaagccggccagcgcccatacgacttcgtgaaggcgaacgacaagcgcacctacggcgacctgtcgacgcgcgacggcatgcgcgaggtcgcgacctatgcgaacggcgtcggcccgtacaagacgtcgatcatcgcggtcgccgcggacggcacgctgcagcaaccgacaccgtacgtgcgctacgcgcacgaggccggcctcgtcgtgcatccgtacacgttccgcccggagaacaacttcctgcccgcgtcgctgaaggacggcggcacgccggccacgcgcaacacggcaggctcggtgcgcgagatccaggcgtacctgcgcgcgggcatcgacggcttcttcaccgacgatccggccgtcggccgcacggccgtcgatacgttcaagcgctgacacgcgcgtcgaccgggcgcggcgcgcgacgcgcgcgttgcgcccggttgcatcgcatcggtcagatcacgttgaagtggtgcgtgccgtcccgcttcaactggtcgaccagcccgtattcccaatcgagatacgcctgcatcgcggccgccgcgttgtcggtgccttcgtacgggcgccggtagcggtcgacacgcggtgacgccaggcgcgtctcgccgctttcgagcggcagtccggcgtcgatccacgcggccgtgccgccggtgagcaccggatctcggccgaagccggcagcagcgcacgcgcgtcgtccgccgcaaaccgcgcgagcaggctcgacccgcacgtgaacacataacgcttcgcggccggaatcgccgcgagcgcgtcgcgcagctgcgcacgcacggcgaaccacgcgcccgggatatggcgcttcacgtagttcgcgctggccgtcacgtcgacgatcgccagctcgccgggcgccgcctccttcagccagcccgcgagcgtcgcgggcgatacctccgccacggccggcgtcgccggcacgtcgcgcggcggctggccgcgctcgccgaaagcggccgcgccggccggctcgacgacacgcacgtcccaacccatctgcgcgagccacgacgcggtcatgtcggcgcgcacgccgtcgtcgtcggcgagcacgatccgcgcgccgcgcacggctgcgtgatggtcggtctcctgcacaagctggccgcccggcgtgctcaggaaacccggcagatggccggcttcgtattcctccggcgtgcgcacgtcgaagcggtacagcgttcggcccggttcgtcgagcgcggcgacgtcggcgagcgcgatgcgcggcacgcccgcgcgttcggccaccgcgcgcgcagcgcggcgcgcttcgtcgcgctgcgtcgcgtcgatgtcgtccggaaagcgccgcgcggcacccgctcgagcgtctggcccgcgagcgtccagccgatcgtgccgttgcgcagcgccgcgaccggattcggcagccccgcgttgacgagcgactgcgtgccgatgatgctgcgcgtgcgtcccgcgcagttgacgacgacctgcgtcgccgggttcggcgcaagcgcgcgcacgcgcagcacgagttccgcgccgggtacgctcgtcgaggtcgggatgttcatcgtctggtattcgtcgaaacggcgcgcgtcgacgatcacgacatcggcctgggcgtcgatcagcgcctgcacctcctgcgcggacagcgacggcgtatgccgctcggcctcgacccattcgccgaacgacttgctcggcacgttcacgtcgatgaacagttcgccgcccgccgcgagccagcccgcgaggccgccgtcgagcagccgcacgtcggtgtagccgagttgcgcgagcttcccggccgcgcgcggcgcgagatcctcgccgccggcttcgccgaatacgacgatcggcgtgtcgcggcgcggaatccgcgtccacgcgtcgagttcgagtttcgacagcggaaagttggcggcccacagcgggtggccctgcgcgtacgggtcttcctcgcgtacgtcgatcagtgcgatctcgtcgcgggcaagcaggcgcgcgcgcacatcctggtacgacgcgacgggaaaacgggaagtggaatcggcggagtgcgtcacgatgtctctgtattgaatgcgttgaagtcggtgaagaaagcggaacggatcaatcttgggcccgccggcgcgtgcgggcaactggccttccggccggtcgcttgcggccggccgcatcggcgggcgttgcatcaggcgttcgaatagcccgacacgaagggtttcacggtgccgtcgtccaggtacaccgcgcgctcgaccttgccgatgttcgcgccgtacacgtggatgctgatcgatacctgatcggcgaacgcgttggtcacgcgatggacgtcgccgatgcgcggcgacacggcctcgatctcgcccggcgccagccgcacggcttcgccggacggcaccggccggcccgctgcgtcgaaccggtacggctgcgagaattcgccgccgcgcagcatcccgatcagcccccacaccgtgtgattgtggatcggcgtcgtctggccgggaccccacacgaagctgacgaccgagaaccgctcgtccgggtcgagatgcagcaggtattgccgatagcgcgcggggtcgggctgcgcgaacgcgtcgggcaaccagtcgtcgtgttcgacgagcgcggcgagcagcgcaccgccctcgtcgaggatgcgcgcctcgtccgcgccggacgcgagcagcgcgcccagaccgtcgacgaacggacgcagcggcgtctgatgcaacgaaagcgtactcatcggctggctcctcgaatatgatgccgaatatgatggatcgtcatgatgcacctgaaagaccatgcagaacaaacatgaaaattagcgatatcgacgcttttgcagcggtggtccgctgccagaccctgagccaggccgcggccgagctcgggatgacgcagcccgcgatcacgcggcgcgtccagaatctcgaggaagcgctcggcgtgaccctgctcgatcgcaacacgaagccgccgcgcccgaccgacatcggccggcaggtcttcgagcagtgtcgcgcgatcctgcgcgaagtcgatgcgctgcgcgagctgacggccggcgagcagccgcccgccggcgagttccggatcgggctcacgcagggcctcggcgaactgatgctgcccgcgctgatatccgaactggccgcgcagtggcccgcgctcgcgacgcaggtcacgaccgcgtggggcggcatgctcgtcgagcgcgtcgcccgccgcgaactcgatgcggcgctcgtgttcctcgcgcgcgagatggtgctgccggcacaggtcgacggcgaacggctgctggccacgcggctcgtcgcggtcggccgcaagggtgactggccgcgccgcagctaccggctcgccgactgccacgctcatggctgggtgctcaatcccgacggttgcggctttcgtgcgggcctgcggcgcgcgctcgacgcgcagggcctgccgatgccggtcacgctcgacacctacggccgcgacctgcaactgcagagcgtcgcgaacggcttcggcatcgggctgatgccgctgccgctcgtcgaaggcagcccgctgcgcgacgcgctcgacatcgtgccgctcgccgatttcaagccgcacatcgatctgtggttgctgcgccggcacgatgcggcccgcttcggcgcgccgctcgcggccgtcgccgcgcatgcgcgtgcggcattcgcgctgcccgagcaggcgcacgaccaggcgcacgaccaggctgcgtgaccctatcgggcggcggcagcatcgcgccgcccggtcgatgctcgcgccagccctgctccgctcacgcatcgctgcggtcgcgctcggtcccgttgaccgacgccccgcccgtttccgtctcgccgcccgctctgcccttcgcttcgacccggctcgccgcgtcgagcaccgcccgccccgccgccaccgcgatcgcgtcgtcctgcggcgtatgcacgcggctgcacagcacgtcgcgatagtggcgttcgagcggattggcgcggctcaacccgtgattgcccgacagcttcagcgcctgctcgaccgcacggatcgcgtgctcggtcacggtgcgcttgaccagtccgctcgtcgtgaccggcggcgcatgacccgcgtcggtgcgcgcgatgtgatcgtcgagcagcacgcggttcgcgtgcagccagccctcgatttcgccgaccgcttcctgcacgcgcggcagcgtcgcgagcggtgcgcccagcccgctcggcgcacgcgtcgtcgcgaattcgaccacccagtcgcgcgacgcgcgcgccaccgcgtcgtacaggctgccgagcagcgcgaccatccacgcctgctggtcggcctgcgcgtcggcatccgcgtgggtcgcggccgacacggcccatgcgtccggtgcgcgcacgtcgaccgcgtgatcggccggcagccggacgtcgtcgaacacgacctcgtggctgcccgacgcacgcaggccgaggtgattccagctttcgatcacgcggatgcgatcgccatccgcatcgcggtcgcgcggcacgagaaacacgccgacgcgcggcgccggttcgtcggtgcgcgcccacacggccagccagcgcagcgccggaatcccggtgctgtacagcttgtggccggacagccgccagccgtcgccgtcgcgccgggcaacggtttccggcaggccgccgcgcgacggcgaaccgagcgcgggctcgacccgcagcgcgttgatcagcgcaccgtgcgtgaccgcgctgtcgaacaccgcgcgccgcacctgtgcgggccagcggttgtcggcccggccgagcgcgcgatgttgcagataggtcatcgtcagcaccagcgcggtggccggatcggcccgcgcgacggcggcgacgatccggctcgcctgcgcgagcgtcgcaccggcgccgccatgctcgcgcggcacgacctgcgcgatcagccccgcgcgatgcagccgcgcgaagttctcgtgcggaaagcggccatcgacgtcgttgcgcgccgcatcggcggcaagttccggcgcgaggcgctcgagcagcgcggcgacgcgtgcgtcgtcggcatcgtcggtgggcaggaggcgcagcgcgggcggctgcggcgacggcgaggaagcggcaaggctggcggacatcgaaacggattccctgggtaatacggacaggcggcaagcgcgacggagatcggcaaccgcggcaatcgatcgccacgcggcgcggtatcccgtgaaccgggcgatccgcaacgcgtgccccggattcgccggcgcccgcgcgcccgatcgttcgtgagcccacagcgtatgcgcagcgcacacgcgcccaaaccatgcaaatctgatattcaaatcgggattgattatttccattccgcatgatcgcggcgttaacctgcgctccattcctgcccggccgcgcgccgggacatccccgcaccggagacccagatgagcgtcgaattcatcggcatgatccagagccagaagcagtcggaaatccacccgccgtccggccccgtggtcgatcccggctacgtgcgcgactttgcccgcgcccacgagacggccggcttcgaccggatcctcgtgccgcatcactcgaccggcccgtcggcgacgctgacgatcgcattcgcggcggccgcgaccgagcgcatccacttcatgctcgcgcatcgcccgggcttcaccgcgccgacgctcgccgcgcggcagatcgcgacactcgaccagttcagccgcggccggctcgccgtgcacttcatctccggcggctcggacagcgagcagcagcgcgacggtgatttcctcgaccatgacgcgcgttatgcgcgcaccgacgaatacctcggcatcctgcggcggatctggaccgaagcgcagccgttcgatcacgacggcgcgcattaccggttcaaacaggggttctcggaagtgaagccgttccagcagccgcatgtgccgatctatttcggcggcgcatcggaagccgcgctcgccgtggccggcaagcacgcggacgtctacgcgctgtggggcgaatcgctcgaccaggtgcgcgacctgacgacccgggtgcgcgccgaagccgcgaagcacggccggcaggtgcgtttctctgtgtcgttccgcccgatcctcgccgcgaccgaggacgaagcgtgggcgcgtgcgcatcgcatcctcgacgaaacacgccggctgcgcgaagcggccgggctcggcgccggcggcccgcagcaaagcgaaggcgcgcgccgcctgctggccgcggccgaacgcggctcgcgcgtcgacaagcggctgtggaccgagatcgccagcctcaccggcgcgcgttcgaattcgacggcgctggtcggcacgcccgaacaggtcgccgacgcgctgctcgactactacgacctcggcgtcacgacgttcctgatccgcggcttcgatccgctggaagacgcgatcgactacggccgcgaactgattccgcgcgtgcgcggcgccgtcgccgcacgcgacgcggcgccgcgcggcctgacgcaacccgggagacccttacgatgtccgccgttccgtccacactcgaacgcactgcgtcgggcctcgcgctcgccgcgtcgccgcgccagcatttctggttcgatccgcccgcgccgcgcatcgacgtcgccgccgagcgccgtcaccgtcaggagcggctcgcggccgcgttccgcctgttcgcacgcttcggcttcgcacaggggctcgccggccacatcaccgcgcgcgaccccgaactgcccgaccacttctgggtgaatccgctcggcgtgcatttctcgcagatcaaggtgtccgacctgctgctcgtcaacgcgcgcggcgaaaccgcgatcggttcccgaccgctgaacaaggccgcgttcgcgatccatgcggccatccacgatgcgcatccgcacatcgtcgccgccgcgcatacgcattcgacgtacggcaaggcgtggtcgacgctcggccgcccgctcgatccgctcacgcaggacgcgtgcgtgttctatgaagaccacgcgctgttcgacgacttcacggggatggtcgtcgacacgagcgaaggcgcacggatcgccgatgcgcttgcgaaaccggacggcaccacgcacaagggcgcgatcctgaagaaccacggaatcctgaccgccggcccgacggtcgaggccgccgcatggtggtacatcgcgctcgacaacgccgcgcacacgcagttgctggccgaggcggccggcacgccgcaaccgatcgatcacgccaccgcgcgtcacacgcacggccagatcggcggccccgagggcgcgctgcatgcgttcgacagcctgttcgcgcgcgtcgtcgccgacgaacccgacctgctcgactgagcgccttcccgcacgaccggagaccagaccacatgacccgaaccgccgcacccgcgcccgccaatgcacacgacacgcacgacgacaaacgccgcaagctgctgcgcgcggccggcgccgccgcgctcgccgcgcccgcgatcacgcttggccgcaaggcctggtcagcgccgccgctgaagaagctcacgttcgcgtggaaccagaacgcgttctgcctgacgccgatcgtcgtcgcgcaggagcgcggcttcttcgagaagaacggcctgaaggtcgaactgatcaactacagcggctcgaccgaccagttgctcgaatcgatcgcgaccggcaaggccgatgcggcggtcgggatgatccaccgctggctgaagccgctcgaagccggtttcgacgtgaagatcatcggcagctcgcacggcggctgcgtgcggctgctcggctcgaaggccgccggcgtcacgacgctgcaggcgctgaagggcaagacggtcggcgtcagcgacctggccgcgcccggcaagcatttcttctcgatcctgctcgcgaagaacgggatcgatcccgagcgcgacatcacgtggcggcagtatccggccgacctgctcggcgtcgcggtcgacaagggcgagatccacgcgatcgccgacggcgacccgaacctctacctgctcgaaaagcgcagcaacggcgcgtacacggaactcgccacgaacctgtcaggcgaatacgcacgcaaggtgtgctgcgtgatcggcgcgcgcggcgatctcgtgcgcaacgaccggccggccgccgccgcactcgcgcgctcgatcgtgcaggccaccgagttcacgcacgacaacccgaacgaagccgcgaaggtgttcgcgaaatattcgccgaagatcagccccgaggatctgcgcaagctgtacgcgacgctcacctacacgcaccacccgaccaatgtcgacctgcagcaggaaatcgcgttctatgcggacgatttccgccgcatcagcgtgctgaagaagagcaccgacccgcagcgcttcgcgcagcaggtctatgcgaacgtgctcgggtgacgcgatgtcgacgatcgaacacgcctccaccgcgcgcaccgcaccgtcaccggccggcggtgcgcctgcttccgctgcttccgcacgcgtggcctgcacggcctgcgaagcgacgcttgcggccgaagcgcgcgcgcgcgcacctggccgaccggcatcgccgccgcactcgcctgggccgcgctcggcgccgtcacgcagctgtggccgaaccgcatcgtcggcttcagcgactgggcgtacacggacacgttcggcacggccgcgtggacgatcgccgcgttgctgctcgccgccgcgacgctcggccatctcgtcgccgcaacgcgcacgcggctcgcgcgcgtgcgcccggccggcccgtggctcgtcgcgctgccgctcgtgctcgccgcgtgggaaatcgtcaccgcgaaaaccggctggctgccgacgccgttcttcgcgccgccgcaggcactgatcgaggtctacgtcgacgactggccgcgcctgctcggcagcgccggcaacacgctgaagctgctcgcgctcggctttgcatacggcgtcgcggtcggtttcgcggtcggcgtgtcgatcggctggtcgcgccggatcggctactgggtgcacccggtgctgcgcgtgctcggccccgtgccggccaccgcgctgttgccactcacgttctacttcttcccgtcgagctattccgccgccgcgttcctgatcgcgctcgccaccggcttcccggtcgcggtgctgacgtggtcgggcgttgcgagcgtcaacaagcagtattacgacgtcgcgcgcacgctcggcgcgaatgcgcgcttcctcgtgctgcgcgtcgcgattccggccgcgctgccgcacgtgttcgtcggcatcttcatggggctgagcgcgtcgttcacggtgctggtcgtcgccgagatgatgggcgtcaagtccgggctcggctggtacctgagctgggcgcagggctgggcatcgtacgtgaacatgtatgcggcgctgatcgtgatggcgctgctgttttccgggctgatcgcgctgctgttcgcggtgcgcgaccgcgtgctcgcgtggcagaaaggaaccgtcaaatggtgaacgccgccgtactcgaatcgtccgcttccgcttcgcccgccgcgtcgcctgccgtcacggcgccgcgcggcgcgcgacatccgccgcgtgagccatgcgttcgacggccccggcggcccgctgcccgtgctcgacgacgtcacgctgtcggtcgcggccggcgaattcgtcgcgctgctcggcccgagcggctgcgggaaatcgacgctgctgcgcctcgtcgcgggcctcgacgccgcgcggcaaggcggaatcgcgcaggacggcgtgccgatcgagcagcccgatccgtcgcgcatcgtcgtgttccaggacccgacgctgtacccgtggcggcgggtgcgcgcgaacgtcgcgctcggcctcgaggcgcgtggcgtggcgcgcgcgtcgcagcatcgcgtcgacgatgcgctcgcgcgcgtcggcctgcaggaattctcgaacgtgttcccgcatcagctgtccggcgggatggcgcagcgggtcgcactggcccgcgcgctcgtcaacgatccgcgcctgctgattctcgacgagccgctcggcaagctcgattcgctcacccggctcacgatgcaggccgaactcaccgcactgtggcaacgcgacggtttctctgcattgctcgtcacgcacgatgtcgaggaagcgctgttcctcgcgcagcgcgtgatcgtcttcgggccgcgtcccgcacggatcgtcgccgagttgcgcgtcgacctgccctatccgcgtcatcgcggcgacccgcgcctcgccgagctgcgtcacgacgcgttgcggcatctcgggctcgatgcgagctggtagatgcgcggtaccgttcgacgatgggccgccgtgcggcggaacgtagccgatgaatgcaccgacgttctccgactgggcgctgctgtttctgcaagggctgtatcgcgcgcaagtcgcgctgtcgcgcgtgctgcatgcaatcgggctgacgggcgacgccgacggccagcctgcctggccgtgggcccgtcgcatcgcgctcgaaacgctgcgcatcgacgccgggctcacgcggcaactcgcgttcgccgtcgcggcgacgacgctggccgccgtgctcgcgtgcatcgcgctcgcgttacgcaagcggcgtgtggcgtcggcgcttgcggtgcttgccgcgctggccgttgcgtggttcgcgccgtggccgccggcttcgctgtggctttcgcccgccgtgccgacgagtttccagcgcgatcccgcgccgttttcggtatcgaacgtgatgcgcggcgcgcacttgtatgcgcaacactgcgtggcatgccacggcgtggacggacgcgggaagggccgcttgcggccacgctccgcactggccgccgaccttcgccggcgccctgctcgcccgccgcctcgacggcgagctgttctggcgcgtgcgtcacgggacacgcgacgaacgcggcgcgccgacgatgcccggcttcgccgcgacgctcgggccccgcgacacctgggccgtgctcgactacctgaaagcgctcgccgcgggcagcggcgcgcaggcagaaggcgcgtggcccgtgcccgtgccgctgccggcgctcgacgtgcgctgcggcagcgccgcgccccaaccgctcgatcgctggcgcgcaggccagcgcgtgcgcatcgtcgccctcgcgccgggcgcgccgcccccgccggaagacgcgcgctggcaaaccttgctcgtcacggcaagcggcacgcccgtggcgcaggcggccggcgcggcgcgagccgattgcgtcgcgtcgacgcccgatgcatggctcgccttcgcgacgatcgccggcgtggcgcccgccgcgctcggcggcacgcagctcctcgccgatcgccgcggctggctgcgggcgcgcgcgttgccgggcagcacgggctggtcggacgccgatctgctgtgccgctcggacgccacgccacggccggcagtaccggccgcgaacggcgacgcactgaccgcgctgctgctgcgcgtcgacacggaacccgtgcgcgacgtacaggccgggctcccgcattgatcgaatccctgactttctcttccgaccgaacttcacgatgaatccgacccgacgccacttcctcgcgcaagcaagcgccctcgccgcgatcgccgcggccccggccgccgtgcgtgcgcaatcgggcacgcggccgctgctgcgcgccggcgaccagaaaggcgggctgcgcgcgctgctcgaagcagccggcgaactgaacggcctgccgtacgacatcgcgtggaccgagttcccggccgccgcgccgctcgccgaagcgctgaatgcggccgccgtcgactgcgggccgatcggcgatgcgccggtgatcttcgcgctcgcgtcgggcgcacgcatcaaggtgatcggcgcgaaccgctccgacccgtacggcacggcggtgctcgtgcggcccgatgccgcgctgaaagggccggccgacctcaaaggcaagcgcatcggcaccacgcgcggctcgatcgggcatttcgtcacgctgaaggcgctcgacgcggccggcctgcctcccgacgccgtctcgttccgcttcctgccgccggccgatacgatgcttgcgctcgcaaccggttcgatcgatgcgtgggcgacctgggagccctataccgcactcgcggaaacgagcgggcgcgcgcgcgtgctcgtcagcggccgcgggctgtggtcgggcctcagctacatcgcggcgaccgacgcggcgatcgcgtcgaagcgcgacgtgctgcacgatttcctgcggcgcgtcgtgcgcgcgcaggcgtggtcgtaccggcatgccgacgcgtattcggcggcactcgcgcgcatcatcggcattccgccggcagccgcgaagctgcagttcgagcgccgcaacacgcgctggttgccgatcgacgcgacggtcatcgccgaacagcagcgcacggccgacttctacctgaaggcgggactgctgcgccagccgctcgacgtgcgtaccacgttcgaccccggcttcccgctcgcatgaccggccgcgcgacgcagcgcagccgtccgaacggctgcggcgtgatctggcacaatcgcagtctcgccatccgccttcagccagcgtcatgccagccatcgccgaactcttcgtctatccgatcaaatcctgcgccggcatcgcgctgtcgcgcgcgcaactgctcgaaacgggcctggcgtacgaccgccactggctgatcaccgaccccgccggacagatgatcacgcagcgcacgcacccgcgcctcgcgctgatccgcaccgcactgaacagcgatgcgctattgctgaacgcgccgggcatgcgcgagatccgcacgccgctcgacggcgacgtatcgcccgccacgccgaaaatggccgcgaccgtgtggcgcgacaccgtcgatgcgatcgacacgggcgccgaaacggccgcctggctcaccgaattcctcggcacgcccgcgaagctcgcgcgcttcgcgcccgacgcgcgccgcggctgcaaccgcaaatggaccggcgagatcgatacgcacacgcagttcgcggacggctacccgctgctcgtgatcggccagtcgtcgctcgacgaactgaacgcacggctcaccgccaaaggtgcaccggcgattccgatgaaccgcttccggccgaacatcgtggtgtcggatctcgacgcgtacgaagaggatttcgtcgagcatctcgacacggaaggagcgtcgcccgtgcggcttcggctcgtgaagccgtgcacgcgctgcccgatgccgacgatcgaccaggtcaccggcgcgcccgatcccgcgtggccgcacgagccgaccgacacgatgcagacctatcgcgcgaacccgaacttcggcggcgagctgacgttcggcatcaacgcgatcgtcgtcgaaggcgcgggcgggtggctcgaagtcggccagtcgctggaagcggagatcgggttcggcgattgacgcgcgtacacggcaccgcgcatccgatcacatcgtcttcgtagcccggaagccgcccgagcggcttcctgcttcccgcttcccgctaaccgctaaccgcttacccgttaccgcttccggctgcccacatcgcaactcgccatcacgcggcatgcgcccccgcgtcgttcgccgccggcaacctgatcgtcacgaccagcccccgccggccgcatcggcaagcgtcaccgtgccctgatgcacgcgcgcgatctcccgcacgatcgacagcccgagccccgtcccttcgaccgtctgcgtcttgctgccgcgatggaaacgctcgaacaccgcgtcgcgctcgtccgccggcacgcccggcccgttgtcgatcacgtcgagccgcgcatgctccccgtcgcgcgacacgcgtaccgtaatcaccgcgcgatcgcccgcataacggatcgcgttgtcgatcaggttgccgatcatctcgccgagcaggtcgggctgcccgtgcacgtcgatgtcggcctcgtgctcgaagccgagatcgatgtcgcgcgcacgtgcgaccggcgaccagtcgagcgtcacgctgcgcgcgagccggtgcagcgcgaccggctggtgggcaacagcgtggccgctgtccgaatcgagccgcgacagcgacagcagttgctggacgatcttcgcggcctgccgcaccgcgccgttcgcgcgccgcaggtgcccgttcgcgcgcggctgctcgtcgggccgcagcgcgagctcgacgcccgcctgcacggccgcgagcggcgtcttcagttgatgggccgcgtccgcgaagaagcggcgccgcgcgacctgcatccgctgcgtgcggccgatgtactggttgatcgactcgacgagcggcgcaagttcgctcggcatcgcgccggtatcgagcggcgtcgtgtcgtcctcgctgcgcgcggcgaccgtcgccgacagccggttcagcggccggagcccgcgcccgacgccgagccacacgatgccgagcgccagcacgaccagcagcccttcctgcagcagcgaccccaccaggatctcgcgcgcgagcgcctggcgcgcctcgatcgtctcgccgaccatcacccacacgatgcgcgactgcgcggtcggcacgtcgtgcaccgggatgcgcagcgcggccatccgcagctgttcgccgcgatagacgacgtcgtagtagcgcgtgacgaacagcgcaccgtcgcccgcgtcgcgcccgtgcggcagcggcaggtccggtagccggtgaccgtgtggccgttgtcctcgcggatcaggtagtagatcttgccgccgtcgctcgattcgagcatttcgagcgcgagatacggcaggtcgacctcgatctcgccgtcattgagccgcacgccttcgcggatcgacttcagcgacgacgacagcgtgcggtcgaacgcgacgtgcgcggcgttcatcgcgcgctggtacgtgagccacgagtcgagcgcgagcaggccgagcagcggcagcagcagccacagcgcgacctgcgtgcgcaggttcgggcggggcatcatgcgttccgccgggccgccgcaacgacgccatgtgccgcgtcggggcgcagcgaaccgccgcggatgggcgggggctcattccgccgcctccgccctcgcctccagcagataaccgagcccgcgcagcgtgacgatcgcgacacccgtgttctcgagcttcttgcgcagccggtacacgtagatctcgatcgcgtcggcgttgaccgactcgtcgagcccgaaaatcttctccgacagcgtttccttgttgatcgcacggccgttgcgcaggatcagcacctcgagcaccgaacgctcgcgcggcgtgagcgacagcggctcgcccgcgagatggaagctgcggtcgatactgtcgtacgaaagcggcccgcattcgacccgcgaatgctcgtggccgaggctgcggcggatcagcgcgcgggcgcgcgcctccagttcggtcagctcgaacggcttcgcgagatagtcgtcggcgccgagatcgagcccttcacgcgatcctcgaccgacccgtgcgcggtcaggatcagcaccggcaccggattgcgccgcgcgcgcagccgccgcagcacttccagcccgtcgagcttcggcagcccgagatcgaggatcaccagcgcgtagtcctgcgtgcgcagcacgtggtcggccgcctcgccgtccgccatgtgatcgacagcgaagcgcgccgcgctcagcgcgtcgttcagcgactgggcgaggttcgggttgtcttcgacgagcagcacacgcatggggattccgggaaggtcagcgacaggccgctacattacatgatcctttccgtcgcgacgcctcgcggaaacaccggttgcgccgccggcgcgcccgcgcgtcggcgggagcgccgaccgtcgccgaacgctcagcgctcggcggcggtggcacggctacgcggcgcgaagcgcgaaccttcacctgcgcgccgccgctcgcgcaggccgaccaccaccgccaggaacgcgacgctcgccccggccgtgacgacgatcatcgggcgcgcggtgccgtccgacagccacgccagcacgccgccgcatgcggccgtgatcgccatctggataaagaagaacagcccggacgccgtcccggcgatcgtcgtgtacggctgcatcaccgcgaactggcaggccgggatcgcgatcccgacggcgatcatcacgacgaacatcgggacgacgagcgccgccaccgccgccggcgcgaccgctccgccgatccacaacgcggcagtgccggccagattgacgcccgccgccgccgcgatgaccgaatcgaccttccagcgcgtgccggtccgcgcgaacacgtgcgagccgatcaggtagccgagcacggtcaggccgaagatcgcggcatacaccgggccggatacgcctcgctgccgctggaacagcgtcgacgattccgcgatgaacgggtagtacgtgcagtacgcgaaactgatcgcgagcgagtagcgcaggaaacggcgctcgcgcagcaggcccgcgtaggtccgcaggagccccgcgcccggcgccggccgcgcgtcgctttcgcgggtttccggcaggtagcgcagcaccatcgccgccgcgaccaccccgcccgccgccagcgatccgaacacgccgcgccatccgagccactcggccagcgcgctgccggccagcggcgcaatcacgggcgacagcgccatgccggccgagatccggcccagcatcgtcgcctgcatcgcggccgggaagcgctcgcgcacgatcacccgcccgaccaccgtgccgcagcagccgcccaatgcctggaagatgcgtgcggcgacgatcgccgcgatgctggtcgagcacgcgcaggcgacgctcgcgaccacgtagagacacaggccgccgatcaggacggggcgacggccgtaacggtcggacaacggccccgacaccagcatcgacagcgcataaccgaccatgtagagggtcagcgtgagctgcaactgggcgtcggtgccgtgcagcgtgtccgccatcaccggcagcgacggcaggtacgcatcgatcgtgacgcgcggcaggcacacgacgagcatcaacaggaacagccagccccactggggtaatgaacgcgttttcatgcggtgagcccgcctccggtcggatcgatgtggtcgactgaaatctaaggtcaaagtgatataagctgaagggccattaaattcgacactgactggaccactatggcgcgaggcaaagccgcgattccgctcgatctgccgtgccctgcggggctgtccacgggcaatccgcagtcgaagcaggagtgcatcgccgacgcgctgcgcgacgcgatcctgaaacgcctgctccccggcgacagcccgctgccgtccagccgcacctcgcggcgcgctggggcgtcgcccggggacggtcgaggcggcatacgaccggctgtgctcggagggctacatcgcccgcgcgcaaggatcggggtcgcgggtatgcgcggtggtaccggacagctacctgcacgcggccgcgcagtcgcgcggccacggcgcgctccctgccgacgcgcgccccgcgccggcgcacacgaccgacgccgccgagccggaacaaggcgtgcgtccgggcgtcccgttcgtcgcacggcttgccgatcccggcctgctgccgatgcagcaatggaagaaggcgctcggggccagcctgcttgccgcgacggcgaacgacctcggggcgacaccggcacaaggcgtcgaaagcctgcgcgacgaaatcgccgcctacctgcgcgaatatcgcggcatcccgtgcagcgccggcgacatcttcatcacgaccggcatccggcattcgatcgatctcgtcgcgcgcacgctgctcgcgcccggctcgacggtgctgatggaggaccccggctacgcgtcggcctggcagatcttcacgatcgcgggcgcgaccgtgatcgacgtgccggtcgatcgggaaggcatcgataccgcgtcgctggatcgccatcccgatgcgcgcgcggcctacgtgacgcccgcccaccaggcaccgctcggcgtcacgatgtcggtgtcgcgccggctcgaactgctcgactgggcgcagcgcaaccgcgcgtggatcgtcgaagacgactacgacggcgaattcagctaccagaccgctccgctgcccgcgctgaaatcgctcgacgcgtgcgatcgcgtgatctactgcggctcgttcaacaagacgctgttctcggggctgcgcatcggcttcatggtcgtgccggcggcactgcggccggcgctgtcggccgtgtggcacgcgaccgcgcgctcggtcggcgtggcgccccagctggcgctggcccgcttcatcgcgcacggcgattttgcgaagcatctgcgcgcggcgcgtcacgcctaccgccagcggcgcgacatcgtgctcgaccagttggcgaaacacgccggcggacggtacgcggtgtccggcgaacacgcgggctttcatttcgtgctgtggctgccgcccggaatggacgacgcaacgtatgtcgcgcaagcccgggcggcgggcgtcgagttgcagcccgtccgcggattctgtcgaagcgcgcggtgcgaagcaggcgttgtcgtcgggtactccgcgctgacggccgcgcacgcgcggcatggcggcaggctgctcgccaagctgctcgcgccctccgtctaggcgcccccgccgtcgttgccgcgccccgcggcaacccgcttccctccgttgccggatcgtgccgcgcgccgcgaaacggcgggccgccgccgcatcgacctcgggaaatccatgacacgaacgacgcgattgtgaactgaaatgaaagcgggctgaaagtgcgccgcaattaacatccgcgtcactcgaacaacacctagacgtaactggaggaagacatgccgtttgcaccgaagcacctcgccgccgcgctggcggtcgttctgggcactgccgccggcagcgccgccgcgcaggttccggccgggtatccgggagttaccagggcgtgatcgacgccgcgaagaaggaaggcaagctgatcgtctactcgacgaccgacacgggcctcgtgcgcccgctgatcaaggacttcgaaagcctgtacggcgtgaaggtcgagtacaacgacatgaacagcaccgagctgtacaaccgctacatcagcgagaacgcggcaagcagcaccagcgccgacgtgctgtggagctcggcgatggacctgcaggtcaagctcgtcaacgacggcctgatggcgtcgtacgattcgccggaaggcccgaacgtgccgcaatgggcgcaataccagaagcaggcgtacggcacgacgttcgagccgctcgcgatcgtctacaacaagcgcctgatccccgaaaacgaagtgccgaaaacgcgcaccgacctgatcaagctgctcgcgtcgcaaccggacaagttcaagggcaagctcacgacgtacgacgtcgagaaatccggcgtcggcttcaatgcgctgacgcaggacgcgcacctgaacgagaaggtcacgtgggaactcgtgaaggcgatcggcaagaccggcccgaagctgcagtcgagcaccggcgcgatgatggagcgcatctcgtcgggcgagaacctgatcggctacaacatcatcggttcgtatgcgtacgcgaaggcgaagaaggacaagtccatcggctacgtattcccgaaggactacacgcagatcgtgagccgcctcgccaccatctcgaagaaggcgaagaacccgaacgccgccaggctgtgggtggactacctgctgtcgaagcgcggccagaccatgatcgcgaaccaggcgaacctgtacgcgatccgcacggacgtgaccggcgagacgtcggccgcgagcctcacgaaggaactcagcgattcgctgaagccgatccagatcggcaccggcctgctcgtctacctggaccagtcgaagcggctcgcgttcctgaagcaatggcagcaggcgatcaagagctgatcggctgatcggctgatcggctccggctgacccacggccgcccgccgcacgtcgcgcgggcggccccttaccgacttccttgaggcggccatccggatggccgcaggggcgaactcatgctttcaaccagcacccgcggcacggcaccggccgcgccacctgccgccggcccgcgcgacgcgattcccgcgctgccggtcaacagcctgcagccgctcgccggcatgctgcgctggatcgtcgtcgcggtcctcaccatcgccgtcgcgctgccgcttggcttcatcctgttccagagcctgctgtccgcgccgttcttcgatgcgaacaagacgctcggcatcgagggcttccgcttcgtcttcagcgatcccgacttctggtcggccgtgaagaactcgttcatcatcgccggcgggatgctgttcatctcgatcccgctcggcggcatcctcgcgttcctgatggtgcgcaccgacctgcccggccgccgctggctcgaaccgctgctgctcacgcccgtgttcgtgtcgccgatggtgctcgcgttcggctacgtggtcgcggccggcccggtcggcttctattcggtgtggttcaaggaactgttcggggtgcagaacgtgccctggaacgtgtactcgatcttcgcgatcacggtgatcgtcggcctcacgcacgtgccgcacgtgtacctgtattcgtctgccgcgctgcgcaacctcggctcggacgtcgaggaagccgcgcgcgtcacgggcgcccgcccgttccgcgtcgcgctcgacgtgagcctgccgatgacgatgcccgcgctgctgttcgccggcgtgctcgtgttcttcctcggcttcgaggtgttcgggctgccgctcgtgctcggcgacccggaaggccacctcgtactcgcgacctacctgtacaagctgaccaacaagctcggcgtgccgtcgtatcacctgatggccgcggtcgcggtgtgcatcgtcgcgatcacgttcccgctcgtgctgctgcagcgccgcttgctgaagacggcgaaccgcttcgtcaccgtgaagggcaaggccggccgaacgacggtgctgccgctcggcgtgtggcgctgggttgcgctcgcgatcgtcgtgctgtggctgatgctgaccgtgatcgtcccgatctcgggcatcgtgctgcgcgcgttcgtgaccaactggggcgaaggcgtcgcgctcgccgaggtgctgacgctgtcgaacttcaccgaactgttcgagcaggacaacctcgtgcgcgcgatcgtcaacacgctcggcatcggcgtgatcggcggcgcgctcgcgatcggtttctactcgctcgtcgcgttcgccggccaccgccgccccgactgggcgaccaagctgctcgactacctcgtgctgctgccgcgcgcggtgcccggcctgctcgccggtctcgcgttcctgtggatcttcctgttcgtgcccggcctgcgcgagctcaagaactcgatgtggagcatctggatcgcgtacacggtcgtgtggctcgcgtacgggatgcggctcatccagagcgcgctgttgcaggtcggcccggaactcgaggaagccggccgcagcgtcggcgcgacccgcagccgcgtgtcgctcgacgtgacgctgccgctcgtgcgcttcggcctgctcgccgcgtggctgctgatcttcatgatcttcgagcgcgaatactcgacggccgtctacctgctgtcgcccggcaccgaagtgatcggcgcgctgctcgtgtcgctgtgggcgaccggcgccgtcgaccaggtcgccgcgctttctgtcatcaacatcgcgatggtcggcgccggtctcggcgtggccctgcgcttcggagtgaaacttcatggataagctcatcgtcgacgacctgcatctcagctacggcgccaatccgatcctcaagggcgtgtcgttcgaactgaaggccggcgaagtcgtgtgcctgctcggcgcgtcgggcagcggcaagaccacgctgctgcgcgcggtggcgggcctcgagcagccgtccgacggccgcatccagctcgacgagcgcgtgttcttcgacggcgcgcagcgcgtcgacctgcccgtcgaacagcgctcgctcggcctcgtgttccagtcgtacgcgctgtggccgcaccgcaccgtcgccgacaacgtcggctacgggctgaagctgcgccgcgtcgcgccggccgaacagaagcgccgcgtgcagaccgcgctcgaccagctcggcctcggccatctcgcggaacgcttcccgcatcagttgtcgggcggccagcagcagcgcgtcgcgatcgcgcgcgcgctcgtctacaacccgccggtgatcctgctcgacgagccgctgtcgaacctcgacgcgaagctgcgcgaggaagcgcgcgcgtggctgcgcgaactgatcgtgtcgctcgggctgtcggccctgtgcgtgacgcacgaccagaccgaggcgatggcgatgtccgaccgcatcctgctgctgcgtaacggccgcatcgagcaggaaggcacgccggccgagctgtacggcgcgccgcgctcgctgtacacggccgagttcatgggcagcaacaaccggatcgacgcgcgtcgcggccgtcgacggcgaacgcgtgacgctcgccggcgacggctgggagctgcaggccctcgcccgcgacacgttcgcaccgggccaggacgcgcaggccgtgatccgcctcgaacgcgtgcaggtcgccgacggcccgggcgcgaaccggctgcaggccgacctcgtcacgtcgatgtatctcggcgatcgctgggaatacctgttccattgcggcgagatgcgccttcgcgcattcggccacgtgccgcgcgcagcgggcaagcactggatcgaattcccgaccaacgactgctgggcgttcgcgaaagcgggctgacccgggcgcggcggcacgctcgccgtcgcgcacgcacaccgcgcacatctcgtcatgtgatgacatgccttccggcggacgtcttccggcgtctgtcgtgggctactgcgcgccgcatccgtttcaccccaacccacaagaaccaaggagacaccgtcaatgaagtcacgcgcagaacgttcgattcgcacagtagtcctcacgggatcggccgccgcggcctgcatcgccgcacccgccgcgcacgcgcagtcgtcggtcacgatgtacgggatcatggatgccggcatcgaatacacgaaccacgcggcgccggagggcggcagcgcggtcaagctgaagtcgggcaacaagaacacgtcgcgctggggcctgcgcggcgtcgaggatctcggcggcgggctgaaggccgtgttccgcctcgaaagcgggatcgacctcgcgaacggcgcgctcgacgacggccccgattcgatcttcgcgcgccgcgcgacggtcggcctgaaaagcaaatggggcgaactgacgctcggccgcaactacaccgtcacctacgactacatgctgccgttcgacccgatgggttacgcgcagaactactcgtgggcctcggcatcgacggcgacgggcggccgcaaggacggcatgttcacgcgctcgtcgaacgcggtgcgctacgacggcgaattcagcgggttcaagttcggcgcgctgtacggcttcggcaacgtgccgggcagcgtgaagaccagctccaaatacgatttcgcggtcggctacgagaaaggcccgttcgcggcggtggtcacgttcgaccggcagaacggcgcggccgacagcgtcacgccggccgataccgtcaactacatccagggcatccacgcgggcctgagctacgacttcggcgacctgaagacgatggccggctatcgcaactacaagcgcacgttccgcaccacggcggcgaaccagctgagcgacacgtactggctcggcggcgcgtaccagttcacgccggcgttctcgctgatcgcggccgtctatcaccagaacatcaagggcggcagcgatgccgacccgacgctcgtttcgttgcgcgcgaactacgcgctgtcgaagcgcaccgtgctgtacgcggccggcgcgttcgcgatcgcgaagcacgaccagaaggtcggcgtgtcgcgcgatttcgtgggctacggcaccacgcaggtcggtgtcacggcggggattcagcagcggttctgagctcgacgatacgggcggcgagcggtcttcgaatcgcgccgctcgtcttgtgcggttcatcgcgcgcgtgccgccctgcatcgcatgcgccgcgcgtcagcgtgacaacgggcgatcggccagcttcccgcacacgacagccgcaccctcatccgtggcccttgccggtcattcgccgtgcatcgtgaacaccaggcgaacgaggctgctcgtatcgctccagtgctcgccaaccgccgacagcggcaccgtgcgcgtgtcgatcgtcagccccgccggtccggccgcgtcgaacacaccgcgcaccgacgccagcaagcgcggcagcgacacgctgccgatgccgctgcccatcagttcgatcgcggtcgcccgcagcaccgcccctggcagcagcacgtccgcgccgccgatcgagccgatctgcacgaaacgcagccggcggccctcgggcgtcgccttcgcggcggccaccagcagcgtctgcgcgctggcgccccacagataatcgagcacgacgtccacgcccgcgcggaaatgcggttcgagcgcgcgtgccaaatgtgcgtcgtcctgctgcaacgacacgacggcatccgcaccggcattcagcaacgcctgcagcgcggccgcgttgcggcccgtcgcgatcaccttcgcggcgccgagatgcttcgcgatccgcaccgccagccgccccgacgtacctgtcgcaccgttgacgagtaccgtctcgcccgcgacgagccgcgcgcgttcggtcagcgccgcccacgacgacatcccgggaatcgcgatcgccgcggccgtgacgtcgtcgagcccatccggcagcggcacgcactgcgtatcgggtgcgatcgtgcgctcggccatcgcgccgaacggtgcgggcgcgccgaagaagtagacgcgctgcccgtcgtcgagacggcggccaatcccgtcgacgccaacgacgaacggataacgcccgtccgacgagtaatgggtgccggccgcgcgccctgcgcgatccggctcagcgcggacgccgtcacgtcgatcaggctgtggcccggcatcgcgtgcggcgcatcgaactccatatgaacggggcgctcgccggcgcccgtcacgactgctgctttcatgacgactccttgaatcggggatctcgatcgacggtcgcggtgcgcatcagcgtgcgtcgagccacgcgcgcagcgcgggatcgcgcacttccagcacgtcaaacaggccgagtgcccgcagcgcgggcaacgcgtcgatcgtgtcggcttcggcgcgcgcccggtcggcgggcgtagcgttcgggtcggtcagcacccgcgcgttgaccagaaacgcgccaacggtccccttgcggatcgtcgttccgccggcatcgacttggttggcatggtcgggaagcatctgttcggctcgcatcgtgtcgtactccggttgttatcgatggacgcagtgtaggcgtgcaaattcggccgatctccggtataacggccattcgataccgatatccggccatgcccgatccgctcctgcccgcccgcttcgtcacgtccgacgacggcccgttcgtcgtcgccgccgtgctgtcgcaacgcgacccgcgtgtgacgccacctcattcgcatgcgcgcggccagctcgtcggcgcgctgagcgggttgctgacgatcggcctcgatgaccaggactgggtcgtgccggcgatccatgcgatctggattccaccgcattgccgccattcgttgcattcgttcgggccgatttccggctggtcggcattcatcgccgaagcgcgatgcgcggcgctgccggatacgccgcgcgcgatccgcacgacgccgctgctgcgcgaagccgtgcagcgcgcggcgagttgggagggttcggagctggatgccgctcgaacccggatcgccgacgtgatcctcgatgaaatcgcgtcgtcggaagtcgaggcgctggggctggcgcggccgcaggatccgcggctgacgaggatcaccgatgcgcttgccgctgatctcgcggacaaccggcggttggaggaatgggccgaatgggcgggaatcagcgcgcggacgatgagccgccgcttcgtggccgagacggggctgacgttcgcgcagtggcgtcagcaggccaggctgctgcgggcgctggagaaaatcgccgacggcgtgccggtgacgacgatcgcgctcgatctcgggtacgacaacgtgagcgcgttcatcgacatgttcaggcgggcgttggggacgacgccggggaagtatatggaggtatcgagatcagaagtcgggacagcgggtggtcagtcgtaaaccatccgcgatggcttccggacacgtaacaattagcaatcaaatagttagtcacgattgtcgaatatatcgagcaaactccccgtctccccgaggacggatccattggcgcttttcactccaagtttgtcagcgcctcgttctggcatcagcccttgactgtgaacgccgtcatccaaagtacgccgtctagaaaagcttccgagcccacgacctagacgatgcgggtgcgccaccctcatcaaaccgttgaaaacggcttatcatatctgagggtacgcccctacaaccactttcagtaattttccaccaacacacacgctatgaaattcgatcacgatatagaggcattcattaaggatttcgtaaaagatctcaggaaaacaatgttgcaatctttgcaggggccgggatgtcaaaaggtgcggggtttgttgactggccgggcctactagcagatatcgcggaagaacttggattaagcgtcaacaaagaatatgaccttatttcactagctcaatatcacgtaaaccatcgcggaaacagatccggaataaaagaaaaattctcgaagaattctccgagcaagcggaaccatcaaaaactcacacaatcctatcgcaactcccaatacaaacatattggacaacaaattatgacacgctcatcgaagataccttaagaaaatatcaaaaatccccgacgtcaagttctccgtaaagcaactcgccaacaccagaccaaaacgagatgcagtagtataaaatgcatggcgacgtccacagcccagacgacgcaataattaccaaagagcagtatgaagcataccatagaagtcacgcccttttattaccgcactcagcggcgacttaatatcgaaaacatttttatttattggatttagcttttctgaccccaatctcgactacgtcctaagccgcctcaatcaagaatcagttgaacgacagcactactgtttcatgaaaaagagtcacgcgccaccgaggacgatgacgaaaccttcaaatacaagcaacgcaaacaaaacctgcgggtcgccgacctaaagagatacaagattaaagcgcttttagttgaagattaccccgaaatctttaacatcctcgaggaaatcgagcgcagatataaaagaataccgtcttcatatcaggtagcgccgaagaatacgggaatggagcagaatagatgcacaaaaatttatccacaaattaagcaaggaaataataagctccggggcaaccatcgtcaacggatttggttggggtgttggaagcgcagttatcaatggcgccctcgaggaaatctatgaaaactacgagaaatcatctgaagatcaactcatcgtcaggccattcccgcaattcgaaacaggaaatcacaaattaagtgatctatgggaagagtatcgccaaagaatgatttcctggctggcatcgcaatttttattttcggaaacaaattcgacaacgacaaaaaatagtacccgctaacggagtactacgcgaattcgaaatctccatcgaacacggcttaattccaatcccaatagcaagcacatcatatgcagcaaaagacatattcaacacaatagagaaagatccacacaaattctacggtgacatgggctggattttcaatgacataaaagaactgtccaacacatcactcacaatcgatgaaattgcaaaaagaccgccatcatcataaagaaacttaacaaataaaatcaacattacatataatcaaaatattcaatcaaattcaccacacacttccaaagagatcacaatggccagaaaaacattcatctcgtacaaatatagcgaagcaatcaacctgagggacaaaatcattgatgcccttggagatgacgcaacatactaccaaggcgaaaccaccgaatcacctgacctcactgatacaagcgtcgaatacataaagaaaaatttgaaggatatgatgtttaacacgtcagtcaccatcgtgattgcgtcaccgaacatcatccaaagcaaatggattgactgggaaattgaatactccctaaaagaaataacaagagaggaccaaacatcacgcacaaatggaatcgtctgcgtcatcatgaaacacaacggaacctacgactggctcatcagaaaccacacgaatgatgacgggtgttcaataagaacgttcgcagattcaaaactttataatatcattaataagaatagatacaattataccggggacgacaaatattcttgcagtcattgcaagacattcaatcaactagacggctcatacatatctctcattgacgaagatcgtttttactcgatccaagcaaatatatcgaaaacgcctacgataaatcaaaaatatttcaaacttcaaaatctcaaagcttcggtgatgcacctttagctcgctaagtcaaacaggccgcaattgcggcctgttctgcgaccccattatcgaaattgccgtccacacaagcacaccactcctgtacggctctagagcgatcgtgttgtcatccacaagcccccatttttacaaccattttgtcgagttattgcgtacgtacatcacgcttccgcgtcgacgtgcgaagcattgagatcaccctggaagccgccccggcacaaagagagtttcaagaactcctaattgctgaccagctgaactcgtagaccgcctcgcgaccattttggggtggttatcgagcagcgcagccagtaaggggcacgacgtagaaaggtgcatgggcttgcatcaggcgccggtgcacacagctctatcattgcatccccgcttgcttcatcgcttcttttcactcaacaagccaggtcgacggcgaggatgcgtcgaagcgcctccttctcgcgattcaggatcgcaattgattcaggggccatcgtcccgtcccaacgcaatccttttgccgatgccccgattcgtcaggtaggcggtcggcgttgctggccaaatctgtcaccggccttcgttcaatacgtcgtgtcgccattcttttccaccagccgccccctccttgaactgccccaccaaccgctccgcactcctcgccagcagcgtcgtatcgaccccgaccgcgacgaacagcgctcccgcttccagataacgccgcgcggacgcctcatccgcgctgagaatgcccggcgccttgccggccgccttgatcgcccggatcgcgccatcgatcgcggcctgaacgtccgggtgccccggatggccgagatgcccgagatcggccgcgagatccgccggcccgatgaacacgccatccacgccctcgacccgcgttatcgcatcgatcgcgtcgagccccgcgcgtgtctcgacctgcacgagcacggccatctcgtcgttcgcgcgatgcaggtaatcgccgacgcgattccaccgcgacgcacgcgccagcgcgctgcccacgccgcgaatcccgtgcggcggatagcgcgtcgcggccaccgccgcacgcgcctcatcggcgctctgcaccatcggcacgagcaacgtctgcgcgccgagatcgagcacctgcttgacgatcaccggatcgttccacggcacgcgcacgaccggatgcgacggatacggcgcgatcgcctgcaactgcgcaagaatcgtcggcaccgtattcggcgcatgctcgccgtcgatcagcagccagtcgaaaccggcgcccgcgaccacttccgcgctgtacggattggcgagcccgagccacagcccgacctgcgcgtcgccgcgcgagcgcggccttgaagacattcgtcggaatctgcatcgttcgctcacctcactcgaagtagcactggatcgtcccgagcggaccgtagtccacgctgaacgtgtcgcccggccgcgccgcgcacggccgcgtgaacgaaccgccgagcacgatctgccccggctccagcgcgacgtcgaagcgggccagccggttcgcgagccacgcgacaccgttcgccggatggttcagcacgccggccgcgacgcccgtttcctcgaccacgccgttacgcgacatgatcgctgcgacccaccgcaggtcgacgtcctgcggcttcacgggccgcccgccgatcaccacgcccgcgttcgccgcgttgtcggcgatcgtgtcgaacaccttgcgcggccgtttcgtatcggggtcgatcgactggctgcgcgcatcgatgatctcgagcgcgggcaccacgtagtcgactgcgtcgtacacgtcgaagatcgtgcagtccgggccggtgagccgcttgccgagcacgaacgcgagttcgacctcgacgcgcggcacgatgaagcgcccggtggggatcgtgccgccgtcggcaaagaacatgtcgtcgagcagcgcgccgtagtcgggctcgtcgatctgcgacgtgttctgcatcgccttcgacgtgaggccgatcttgtggcccttcagcgtgcggccttccgcgagcttgagggcgacccacgcgcgctggatcgcatacgcgtcgtcgatcgtgatgtcgggatggtcgagcgagatctggcggatctgcttgcgctcgcgctcggcgtcgtgcagacgctgcgcgagctggtcgatgagggcggtttcgagcatggtcggatcgggaatggggttcagccggcccgcttgtagcgggcgtggatgttgttgtgcttgtacgagccgctttcgctgaactcggtcagttccatcgacagcgcgaggtaccgtttcgcgtacagttccgcgaaatgcgccttgatcgcgtcgaacagcgcgtcgcacgcggcctttttctgcgcgtcgctgcggcccgagccgatcttcagcgtcacgtgcacgaacgcatcgtcttccgtgccgtcggctacgcagtagtcctgcagttcgatcgcgcgcgagcggatgccgcccgtcgggaacacgccgccctgcgcgatcagcgtggcgttgatcgtgcgcagcagcgcgggaatgcgtgcgtcgtcgcggatgttcgcggtgtattcgacgacgatatgtggcatggcgggtctccagtcgagtgcgtggcgcggtgctcaggccaccgggaagatcgcattgatctgcccggtacccgaactcgcgaaatagtcggtgacgatctcgacgggtttatcgtagcgatcccagccgagcaggccgagcagcatcgccgtgtcgtgcatcccgccttcgccgtggcaatgcgtgttgtactcgggcagcatcgcgcagaaggtcttgaaatcgccctgcttccacagctcgaccacgcgcaggtcgacctgccggaagaattcgcggctgatctggtggatcgattcctcggggctgccgttgtcgttgaaacggtgcgacagcgagccgctcgcgaggaatgcgacgttcgaatcgctcttttctatcgcctcgagcagcgcctcgccgaagcgccggctttcgtcgagctgatgccacatgcaccagccggcgatcgacacgaccttgaagtgctggtcggcgttcatgtagcgcatcggcacgagcgtgccgtattcgagttcgaggctgtcgatctcgtgcgcgcgcgtcccgacgccgcgcgcgctggccgtctcggcgatcagccggccgagcgccgggttgcccggatacgcatactccatgtcgcggatgaaatgcggcagctcgttgctcgtgtacgtgcccgcgaatcgcgcattgcagttcacgtgataaccggcgttgacgagccagtgcacgtccgacacgacgatcgtgtcgacgccgagcgcgcggcagcgctcgccgatcagttgatggccgcggatcgccgcctcgcggcagccgtgatgcctgccgggcaattccgacaggtacatcgacggcacgtgcgtgattttcgcggcgagggacagtttgcccatcgttcaagtctccgtttggttctttcgtgctgcagacgtcccgcgcccgtcacacgccccagcgcggaatgtggtgcgaacccatcgagatgcacacgttcttgatctccgcgaacacctcgaagctgtattcgccgccctctcgcccggtgcccgactccttcacgccgccgaacggctggcgcaggtcgcgtacgttctggctgttcacgaacaccatcccggcctcgatgccgcgcgcgaggcgatgcaccttgccgacatcctgcgtccagatgtatgacgcaaggccgtacgacgtgtcgttcgcgagccgcagcccttcttcctcgtcctcgaacggaatcaggcacgcgaccggcccgaagatttcttcctgtgcgacgcgcatccggttgtcgacgtcggccagcacggtcggccgcacgaagttgccgttgcgcaggtggtcgggcaagcccgccggcttgtccgcgccgcccgcaaccacgcgcgcgccttcctgctcgccgatgcggatataacccgtcaccttttcccagtgctggcgcgtgatcatcgcgccgaggttcgtggccggatcggacggatcgccgaccaccaggttgttcgcgcggcgcgcgaattcctgcacgaagcggtcgtagatcgtgcgctgcacgaagatccgcgagccggccgtgcagcgttcgccgttgatcgagaagatcgtgaacagcgacgcgtcgagcgcgcggtcgaaatcggcgtcgtcgaagatcagcaccggcgacttgccgccgagttccatcgaatacttcttcagacccgcacgctccatgatccgcttgccggtcaccgtaccgccggtgaacgacaccgcacgcacgtccggatggcgtaccagcgcgtcgccggccgtcgcgccgtaaccctgcacgacgttgagcacgcccggcgggatgccggcttcgagcgcgaggcggccgagctggtcggccgtcagcggcgacagctccgacatcttcagcacggccgtgttgccgagcgcgaggcacggcgccgtcttccacgtcgcggtcatgaacggcacgttccacggcgacaccagcgcgcacacgccgaccggctggtacagcgtgtagttcagcatctggtcgtcgaccggataggtgcggccgttcatctgcacgcacacttccgcgaagaagttgaaattctcggacgcgcgcggaatcagctgcttgctcgtctgtgcgatcggcaggccggtgtcctgcgtctccagcgccgcgagcatcggcacgttcttttcgatcagttcgccgagcttgcgcatcagcttcgcgcgctccttggcaggcgtgttcgcccatttcgggaaggcttccttcgcggcgcgcacggccgcgtcgacttcggcctcgccgcccgatgcgacgtcggtgatgacttccccgtcgcgggattcagcgtcgtgaacgtctcgcggctctcgacttcgcggccgtcgatccagtgcttgatggtcatgctctccttgggcgacgggctcagcccgcgcgatagtagtctgcttcgccgacgatcgtgttcacgagccggccgatcccttcgatctcggtcacgacctcgtcgcccggcttcgtgtccgccagcccctcgggcgtaccggtcaggatcaggtcgcccggcgagagcgtcatgaagccgctgatgtgctcgatcaacgccggcacgtcgaagatcatgtcgcgcgtgctgccgcgctgcgtctcccggccgttcaccgtcgtgcgcagcgtcaggtcgcccgcatcgccgatttcgtcgcggctgacgaaccacggcccgagcggcgtgcaggtgtcgcggttcttcacgcgcaggttcggacggtagtagttctcgagatagtcgcggatcgcgtagtcgttcgcgaccgtatatccggccacgtagtcgagcgcctgcgcgcggctcacgttgcgcgcgggccggccgatcacgacggccagctcgcactcgtaatgcatgtgggtggcgtccgccgggcgcacggtgcgcgaccggtggccgatgaacgtgttcggccccttcaggaagatcagcggttcgctcggcgccttgaacgcgagctccttcgcatggtcggcgtagttgaggccgagcgcgaacgtggtgcgcggcgcgacgggcggcagccacgcaaccgcgtcctcggcaacgacccgccccgtatcgagacggatcgcgccgtcgccggccggttcggccgcatgcaatgcaccgttgtagatcacgcgtgccgtcttcatcgtgtttcctccgcgatcagcgtgtgccgcaacgtgccgatgccggccgcggcgatctcgatcgtgctgcccgcgcgggcgcgcggtgcgccgcccgcgacgccgagcagcaagacatcgcccgcgtcgaacgacatgaaggccgtcacgtcggcgatcagttcgcgcacggagcggatcagcgtggccgtcgagacggacacggccacctcgccatcgatccgcacggtcaggccgatcgtgtcgacattgccaagcgcggcggccggcacgatggccgggcccatcgggcagaacccgtcgcggcacttgaagcgcacggcgggacggtagtagtcgggatggggtaccgacacgtcgctggcgagcgtgaagccgtgaaggtagtcgagcgccagcgcggccggcacgcgcgtcgcgcgccgggcgaacacgacggccaccgacgcgccgatctccaggagtcgacgccggccggcacgacgacggtcgcgccgtcggccgcatacgtgttggcgggcttgatgtacaggatcggcgcctgcggcgggcggccataaggcggtgcgttcacggcatcgccgagcgcgtcgagcgccgcacgctcgttgagcagcgcaccgtagacggtaccgatggcgaccggcaacggcggcgccgcggcggtcatgcaagacagctccatgcgtcattcccctgccgcgcgtcgcggcgcatcgtcaatacttaacatcttaagtaaacaatcgaacgctggcaacctcgattaccctgatacgcgaaattcacgcctttcggctgttaagattgatgcgtccccgtccactgctcaccccgatgaaccgtacgctcgaccatcgcaacctggccatgctgctgctcgaggcccgcgaaacgctgatgggtctgttccgccccattctcaaggaattcgcgctgaccgaacagcaatggcggatcatccgcgtgctcgacggcgaaccggcgcaagcgctcgaagcgggacagatcgcgcggcgctgctgcatcctgagcccgagcctcacgggcgtgctggaacggatggagcgcgacggcctgatcacgcgcacgcgcgcgcaggaagatcagcgccggctgctggtgagcctgacgccgcaaagcaggaaactggtcacggaaatcggcccgcggatcgacgagcagtaccggcagctcgaatcgcggttcggcgaggacggcctcgaagacatctatcgcgcgctcgaccggctcatcgagctcggcggcaacacgtgatgacggcccccgttcctgccagccgcgggaacgggggccggtgcggcgcgggcggtcagtgcaccgcgccgcgcatcagctcggtcacggccacgccgcgcgacgtgcgcatgcattcctcgacgtaatcgatgaacggcagcggctcgaaatcgatttcgtcgcgcacgcgacggttgtcgaacacgcgatcgaccgtcgcgaattccccgcagcgctgcaacgcccggccgattacgcgctcgagtgccggatcggttcgcccgagcacgtcgcgcaccacgagcggcaattcggccggcgcacacgccgcgtagcgcggtgcgccggtcatccccgccgcctcgtccatcgcacgcacgatctgcgcgacctgcggcgcctcgtcgccggccgacacgtgatacaggtcgtgtgcgagcgtcggcttgacggccagcagcatcgtcgcgcgcgccacgtcgtcgaccgacacgatatcgatgcgcgtcatcggtcgcgcggtgaagcgacgtgcggcatgcgccagccggaacatccagaacgaattcggcgcgggccgcgtaccgagtaccgtgtggccgaccacatgcgacggccgcaccacgacgagcggcagcccgagcgcacgcaggcgctgctcggtctccgccttcgcatgcaggtagtccgcggcgagcaccgcgcccggcaggccttcttcgtcgcgcgcgacgtcgttcgccgcgtcgcccgccgcctcttcttgcacgatcccgccacggcccgcatgcgcgtaggccgtgccgacgtagacgaagcgcagcaggcgcggcgcccgtgcaaaacgctcggcgaagcgcaccgcatcggcgatgtcggcccgcaggtgcgcgccgtcggccggcgacgcgtggcctgcgcagtgaatcacgtgcgtcgcggcggcgaggcgcggtgcgtcggcgccctgccacacgtcgccgagcgcaccgacgatcacgttcgcgtcggtcaggcgcgacgcccagtacggcgccagccccgcgcgcagcgccgcttcgcgcagccgcgcgacggcatggccgcgatcctgcgcgcgcacgacgcagacgatgcggtcgagcagccccgcattgacgagcgccgtcaggacggtactgccgatgaagccggttgcgccggtcagcaccagccgcccgacgttcgccgccgcgaccggtgcgctggccggcgacacgaggctcgtccgccagttgagcgacaacgcggttttccagatcagcacgatagtctccttcgaagaatcggccgggcggcgcggcgcccgcggttgcgggctgcgcacggctcaccggccgggccggggcctgacgcgcgccccggcagtcccgatcgggcgtgcggcccgcgatcgcgtcgatcgcgtctctggcacgaggcggcggcagccgccgaggacgggcgtccgcggcactggatcgggaatatctcagtgtggggcccgaccgcaggcaagtctgtcccgaaagtttcgtgaaagtgtgccgatttgtatgcgattgtcggagtctgtcgtccagcaatgcagtcggaacgccgcaacatccggtcgcgccgccctccggcatggcggaaccgcgtcggccggcccggtttccgcggccggtcgcgcgcgacagatcgacgcgcctcgcggcgatgtcatcccatgtctcgaagatcgaccgggccctgatcggcgccgcgatcgccgttaggcgtgtgcctgcgcgcgctgccggaataaccatgaatcgtcagacgtcgtttcatctgaaaccgcaatgaactcaattcggatttattgaggattatcacttgcgtttcacaccagtctatctagactgatcaagtcaaaacggtcgaatgttcatttttggagacgatcacaatgcgcctcaccattcggattaatggcagcgaatcagcaacccgaaactcgttcgcggtactgtgggtcgacaccgacgaaggactgtggtcgcgcgaggcacatcagggcatcgatcttccggcctggggcaaggtccgcgacgtcgagggtgcgatggcgctctgcgcggctgatggcgggaatgccgtgtgccagttgaagggactgtcgttcggtgcgacccagcgcgaacagggctccgccgtactcgccggcaatcaccccggtgcatggcggctgcaggcggtcgatcgctgcacgagcgagccggaataccgggaattcatttccgtcacccggtagaaatgatcgacgtaattcgtctgcggttttcgggtttattccggtttcagtgatattcatttcgatattcagtattagcggcgccccttttcggggcgttttcatttatggtgcaaataaataatcgcgagccgggcaattgaccgcgcgccgggggcggtcggcatcgattgtccgggagatcgtgtgagcggatcgatacgcgcagaatcggccgccttcattcgcgtgctgcgtcggtgaagctccgcttccgccctcttttcgtacgccctgttccaccctttgccggatcgccaatttgcggcttttcacggggccggaacatactttcccacacggcgtttactcatttattacaatcgcattattcagactgactcgccgccctccggcggcccgacccggccattgcatgagcgtgaaaaagaagacccaccccgccgatccgtacgcggccgcgaccaagaacccgatgctcgcgtcgcgcctgccgatgtggcgctcgaagctgatcgtgatcatcgtgttcctcgcgttcgccgcgctgatcggccgcgcgttctgggtgcaggtcgcgaacaaggagttctacgtcggccagggccagaaacgctaccagcgcacgatcgagctcgacgcgacgcgcgggcgcatcgtcgaccgcaacggcgcgatgctcgccgtcagcctgtcgacctatgaaatctgggcgaacccgaagcaggtcgccgacaccgactacccgcagatctcgaagctgctcgacatgccgctcgtcgaggtcaagcggcgcctcggcaatgacaagacattcgtgctgctcaagcggcaggtcgacgccgacaccgcaggcaggctcgacaagctcgcgatcgacggcatcacgcagatcgccgattcgaagcgcttctacccggaaggcgaatcggccgcgcacgtggtcggcttcacgaacgtcgaggacaagggccaggaaggcgtggagctcgcggcgaatgcgcgcctgtcgggcacgtccgggcagcgcgaggtgatccgcgaccggctcggccgcatcgtgtcggacacgcgcccgctcgtcccggcgcagcatggcgcgacgatcgagctgacgatcgaccgccgcatccagcagctcgcgttcagccagctcaaggcggccgtgatcgagaacaacgcggtggccggcagcgtcgtggtgctcgacgcgcagaacggcgagatcctcgcgctggcgaactacccgaccttcgacccgaacgaccgcgcgcgcctcaccggccagcagttgcgcaaccgcgcggtgatcgacacgttcgaaccgggctcgacgatcaagccgctcgtcgtcgcgctgtcgatcgacgaacgcaaggtcacgccgaacacgatcatcaacacgtcgccgggcacctacaagatcggcccggccgtgatccacgacacgtcgaaccacggctcgctgacggtctcgcaggcgctgcagaagtcgagcaacgtcgcgctcgcgaagctcgcgctgaacctgcccgccgaaacgatctggaacaagtaccaggaatacgggatcggccgcgcgccggaactgacgttcccgggcgtcgcgtcgggccggctgcgcggctacaagcgctggcggccgatcgagcaggcgacgatggcatacggctacggcctgtcgatgtcgctgctgcagatcgcgcaaacctatacggcctatgccggcgacggcacgctgcacccggtgtcgctgctgaagaacggcaccgaccagcaaacgatcgacgcgcatcgcggccaccgcgtgacgtcgccgcaaacggccgcgtcgatccgctcgatgctcgagatggcggtcggcgaaggcggtacgggccgccgcgcgcgcgtcgacggctaccggatcggcggcaagaccggtaccgcgcgcaagcaggtcggcgcgacctatgcgaagggcaagtaccgcgcgctgttcgcggggatggcgccgatgagcaacccgcgcctgatcgtcgcggtgatgatcgacgagccgcgcggcaagggctactacggcggcacggtggccggcccggtgttcgcgtcggtcacgagcgggtcgctgcaactgctcggcgtgccgcccgacgcgccggtcgagcccgagaagacgccgccggcgaagcccgctgcgccgcagaagacggtggccgcaccgcaagcggctgcgcaaaccaggacggctgcggcaccgaaaaccgccgcaccgctgaagactgccgcgccgtcgaaagtaccggcgcagccggccacctcggccggatgagcacggcacgtccccgcgacacggcgcccgccggcgcgcgcggcacaccggcggcgcccggccgccacgcatttccccgtcttcgggcaccatcccactttctaggaacgccgcacatcatttgagcgttcccgctccctcctcctacaatttttccgcgtgtcgggcagccctgcccgtgcgcgcgactacaaaagagagacgcatgcgattccactggaagacgctcgcactggccatcgcgagcgcggcactggtcggcggggtacccgcccatgccgccgaccccgccgacgtgaaaatcggcttcctcgtcaaacagccggacgatccgtggttccaggacgaatggcgcttcgccgaccaggcggcgaaggaaaagcatttcacgctgatcaagatcgcaacgccgagcggcgaaaggtatcgaccgcgctcgacagcctcgccgcgcaaaaggcacagggcgtgatcatctgcgcacccgacgtgaaactcggccccggcatcgcggcgaaggcgaagcgcgcggggatcaagctgatgtcggtcgacgaccagctcgtcgacggccgcggtgcaccgctccagggcgtgccgcacatgggcatctccgcgtacaagatcggccagcaggtcggccaggcgatcgcggacgagacgaagcggcgcggctggaacccggccgaggtcggcatcatccggatcgcatacgaccagttgccgaccgcacgcgaacgcacgaccggcgcggtcgatgcgctcaaggccgccggcttccccgccgcgaacgtgatcgatgcgcccgaaatgacggccgacaccgaaggcgcgttcaacgcggcgaacatcgcgctcaccaagcatgcgaatttcaagcgctgggtcgcgttcggctcgaacgacgacacgacggtcggcgcggtgcgcgccgccgagggcgcggcatcggcgcggacgcgatggtcgcggtcggcatcaacggcagccagatcgcgctcaacgaattcgcgaagccgaagccgacgggcttctacggctcgatcctgctgaatccgcgccagcacggctaccagacgagcatcgacatgtacgactggatcacgaagaaccaggcgccgccgccgctcgtgctgacgtccggcacgctgatcacgcgcgacaacgaaaagcaggcgcgcgccgcgctcggcctgtgagccggcacaaggagccgacatgacacgcaccaccctcgtgacgggcgccgccggcggcatcggccaggcgctgtgccgcaccttcctcgccgccggcgaccgcgtgctcgcgctcgatcgcgaccgcgcggcgctcgaccgcttcatcgatacgctcggcgacgcgcgcgtaacgccggtcgtcgacgacctgaccgacgccgagcggctgcaatcgacgctcgaatcgcatccgcaggccgacgtgctcgtcgccaacgcgggcacggccgcgtcgaccacgctgcgcgacacgacgcccgccacctggcgcacggatctcgacgcgaacctgacggccacctacatgagcgtcgaagccgtgctgcccggcatgcgcgcacgcgggcgcggcgcaatcgcgatcatcggttcggtcaacggcgtgcatgcgctcgggcatccggcgtacagcgcggcgaaggccgggttgatcagctacacgaaatcgctcgcgatcgaattcggccgcgacggcgtgcgcgcgaacatcgtgctgccgggcaccgtgaagacgcccgcgtgggaagcgcgtgtgcagcgcaatccgcaggtgttcgagcaattgaggaagtggtatccgctcgacgatttcgcgacgccggacgacgtcgcgcaggccgcgctgttcctgtgctcgccggcggcgcggatcatcacaggcgtcgcgctgcccgtcgacggcggcctgctggccggcaatcgcgtgatggcgcaggagctgacgctcgatacgttctactgaaaccgaagcaggcggcgccggcggccgcgcgggccgcccggcgcgctgccgtgcgccgtcaatgcgcggccgcgaccggcttcgccatcctgccgagcacgtgctcggtcatcccgcgcgcgagttcggtctcgcccatgaacacggtgccgataccctcgttcgacagcagcgcggcctcgtcgccgctgttcgtgcacagcacgacctcgagcgccgggttgagcgtgcgcgagatctcgacgatctgccgtacgtcgaacacgtcgggcagcgtgacgaccagcatcccggcgcgcgcgatatgcgcctgcacgagcacgatcggctcgatcgcatcgcccgacacggcggcaacgccttccgcgcgcagtttctcgacgagctcgcgattctgctcgacgacgacgtacgcgatgccgcgctcgtcgagcgcatgggcgatccgcgtgccgaccttgccgtagccgacgatcacgacctgcccggtgagatgcgtctgcggcgtcgacatcggcagcgcggcgagcggatcgtcgcgcgcctcgagcttgcgcgcgaacgccgaatgcttgcggatccacgcaagcgccggatcgatcatcgcgaacagcagcgtgttcatcgcgatcgagatcagcgcgaccgcgaggatcaggctctgccctcggccgacagcagcccgagcgcacggccgagccccgcgaggatgaacgagaactcgccgatctgcgcgaggcccgcgccgaccgtcagcgcggtattcagcggatagcggaacgcaatcacgagcgcgaccgccgcgagcgtcttgccgatcaccacgatcgccgcgacctcgatcacgtgcagcggctccgcgagcaggatcttcgggtcgaacagcatcccgaccgaaatgaagaacagcaccgagaacgcatcgcgcagcggcagcgtctcgtcggccgcgcgccggctgaactccgactcgcgcatcatcatcccggcgaagaacgcgccgagcgcgaacgacacgtcgaacagcttcgccgcgccgaacgcaatgccgaccgcggccgcgatcatgcacagcgtgaacagctcgcgcgagcccgtgcgcgcgacgagccacagaatgcgcgggaacacgcgcttgccgaccaccagcatcaatgcgatgaatgccgcgaccttcagcatcgtgacgccgagcgtgccccacacgctgccgccggccgcgtgcgcgtcgccgggcggcgtgccgccgagcagccccgcgacaggcggcagcagcacgagcacgagcaccatcacgagatcctcgacaacgagccagccgaccgcgatgcgcccgttaaccgtctcgacgagcccgcgcccttcgagcgcacgcagcagcacgacggtactcgccaccgacagcgcgagcccgaacacgagcgccgcaccgacgctccagccccaggtgagcgcgaggccgccgccgagcagtgtggccaccgtgatctggacgatggcccccggcagcgcgatcttgcgcaccgcgagcagatcgccgagcgagaaatgcaggccgacgccgaacatcagcagcatcacgccgacttcggcgagctgctgcgcgagcgacaggtcgccgacgaaaccgggcgtgccggggccgatcacgatcccggcgagcagatagccgacgagcggcggcattttcagcagcgacgcgaagtaaccgaagaccatcgcgagaccgaaaccggccgcgagcaacgcaatcaggctgatgtcatgaggcatcccctcccgagttcttgtaacgatttagtaaggttcaagaacgaaaggataagggatgaggcggaagaatggcgcgccgccgcgaaaattcacgcggcggcgcgccttggcggggtacaaccccggcgaatcgaaaggcaccgcgtggatcgcgcggcgccttgaagcacatcggacaggcggggctggcgccccgccgccccgtcagcgcgacgcttgcgggaaccgcgcgcccggcggcggttcgggccgggtcgacggcacgctcttgcgcaccttcgcgacctgcgcggcggtcaccggcgccccgtgttgccccagctcgtgcgcacgaagttggacacgtccgcgacttcctggtccgacaggcgccagccgaacggcggcatcgtgaacgtcgacggcgcggtgcgcgtgccctgcagcgcgctgccttccagcacgacgtggatcagcgaggtcggatcgtcgccctgcacgaccgggttgccggcgagtgccgggaacacgcgcgtgtagccatggccgtcgctgcggtggcaggccgtgcagttgtcgcgatagacggccgcgcccggcttgctcgcatcgccggcctgcagggccttggcagccgccgcgtcgtacacgtgcggctgctcgccctgcacgcgcggcggcagcgtcttcaggtagcgcgcgattgcgttcaggtcgtcgtcggtcatgtgctgcatgctgtggccgaccacgtccgtcatcccgccgaatgccgccgtgcgcagcgtgcggcccgtcttcaggaactgcacgatctcggtttcgttccacgtgccgaggcccgtgcgcggctcgccgcgcaggctcgtcggcacccagccgtcgatcgccgcaccgccggccaggaagtccgggccgtccgcgtcggtcagcccgcgctcctgcatcgtcggcgcgcgcggcgtgtggcacgcaccgcagtggccgagaccctgcacgagatacgcgccgcgcgcgaccaccggatcggtgtacggcgccgcgtcgaacggcttcggcgtcggggcgaacatcttgcgccagatcgtaagcggccagcgcatcgacagcggccacacgatgtcgaccgcacggttctcgtgctcgacgggcgcgacgccgtgcatgaagtacgcgtacagcgccttcatgtcgtcgtcggtcaggcgcgcgtacgacgggaacggcatggccggatacatcgtgtcgccgttcttgcgcacgccttcgcgcaccgcgcgcgtgaagtcctcgtaagtccagccgccgaggcccgtcttcgggtccggcgtgatgttcgtcgaatagatgccgccgatcggcgtgtcgaatttcagcccgcccgcgaacggcttgccgccgctcgcggtatggcacgcgatacagtcgcccgcgcgcgcgaggtattcgccgcgcttgatcgggttcgcgtcggcggatcgggccgcggttgcagtcgccgggccggaagccgccgcaggcgcagccggctgcgcgaacgccgtcgagcctgcgaagccgagcgcggcccaggccgcgccggccgccagcgcgcgcgacatccggcgcgcgacgttgtggttcatcgtcctcttcatacggtcaccagcggagcgggatttttcaggtattgctcgcggatcgcacgtgccgaccagtaggccagcgccgcgatgatcccggtcgggttgtagccgatgccctgcggcagcgccgatgcgcccattacgaacacgttgtgcacgtcccagcactgcaggtaacggttcagcacgctcgtcttcgggtcggtgcccatgatcgcgccgccgacgaggtgggtcgtctggtacgcgcgcgaatcgaagtgcttgccgaactcgcgcgtagacacgccgatcgccttcggccccatcgcctccgcgatcttcttcatctgcccggtcacgtactgcgccatcttgatgtcgttgtccttccagtcgaaggtcatccgcagcagcggctggccgtacgaatcgcgataggtcggatcgaggtcgaggtacacgtcgcgatacgacatgttggtgccgtgcgcgtccatcgagatcgtgtgcgcgtagttgtccttgaccgccttcttccacgccgagccccactgcggcgtaccgggcggcgtcgcgatgccgctgatcggcttcacgccggcctggttcacccacagcggcgagccgccgacgaagccgagcgggccgtggtcgaagttgtccgcgttgaaatcgtccaccgcgacgccgttgccgcccgcgccgatgaacggattcgtataggtatccttgtcgaagaacgccttgatcgtcgacaggttctggtacgcgaaattgcgacccaccacgccttcgcccgagatcgggtcgtacggcttgccgatgcccgacagcagcagcaggtgcacgttgtggtactggaacgcggccacgatcacgagatcggccggctggtgcacttcacgcccggccgggtcgacataggtcacgcccgtcgcgcgcttcttcgtgtcgtcgaggtcgacgcgcagcacgtggcacttcgagcgcagctcgaagttcggcgcctgcttcagcgcgggcaggatgttcaggttcggcgacgccttcgagtacatgtagcacgcgtaaccgctgcagtagccgcagaagttgcacgggcccatctgtacgccgtacgggttcgtgtacgggcccgacgtgttcgccgacggcagccggtacggatgcaggccgagcgacttcgctgcatcggagaagcgctgcgccgaatacgtgttgagctgcgcgggcagcggaagttgtcgctgcggttcgcttcgaacacgttgccgtcgccgaccaccttgccgccgaccttgtacgcctgccccgacgtgccgaacaccttctccgcgaaatcgaaatgcggctcgagctcgtcgtaggtcacgccggtgtcctggatcgtcatcccttcggggatgaacttcttgccgtagcgctcttcatagtggctgcgcaggcgcagctcttccggcgtgatccggaaatgcacgcccgaccagtgcagccccgcaccgcccacgccttcacccggcaggaacgcggcgagctgccggtacggcagcgcggtgtcctgcagcccgtggcggatcgacaccgtcgtcttcgacaggtcgaggaacagcttcttgcggatgttgtaggtcagctcgtcgatcgtgttcggatacgcgccgtccggataggtgtcgcgatactcgccgcgctcgagcgcgaccacgttcaagcccgcttcggtcagttccttcgcgagaatcgcgccagtccagccgaagccgacgatcaccgcatcgacatgcggtttttctctgcggccatcagctgcgctccccgttgatcgagacggggccgtacggatagggcttgccgctctggttgacgaaatccatgaagtccgcgcgtgcgccgggaaaaccgatcatcttccacgcggccatgtcgtgattgccgccatgcaccggatcgcagaaatagccttcgcgcgtgttctgcagcagctggccgaagaacacgccgggcggcacgtcgtcgatctgcgcgccgcccttctccagcgcgccgagcacggtgtcgcgcgtcggcgcgtcgagatccgcgaacgccttgccgtgggtcttctcgcaatagcggttgaccgccgcgataccgagccggtagatgtcgcgcggcaccagcttcagctggtagccaagctcgggcacgccttgctggaacggcccctgcatgtaccaggtcgcgccgtgcgcatacggcgtctccatctggcggtcgatgaattcgggcaccccggattcgagcgcgccggggccttcggcgtcggccggaatcagccggtcgacggcggcctggacgaacgcccattccttcgcatcgaagaaggtcggcttgtacggggcgcgttcggcgccggccgatgcaccgggcgcgttgccggtcgtcgcggaaggcgacgacgagcgcaggtcgcagccggcgaccgacgcgatcggcacgagcgcgaccgacgtgcgcaggaaacggcggcgcgagttgggtttgtcaggtggcgtggacatggtcggatgttgatcgttggggatctcggggcccggacgcgcgcactccgcatgcggcatgtccggcatggcagccttgccgcaaccggctggccgtcctgttctttcgtctgttgcgaacaacctcgatgcaggcgccgcccgtgcaatgcgcggcagcgccttcatgcggccgcgcatcgcgccggttcaggctgcgctgcacggatcggcttctttgtgagccctatcgtctgacaaataccggcatctgcctgcatctgcccctcatcgctcatgaccctcattcaacttagacgtcgcgtttgccgacagcaagcgcaacgtgcacgaccctctttcgggcccggcgacaagtgtcgcgaattatatatggaaccggttccattcaaaggtacgccaatgcaattcaatgcatcgaaaatcgcaacaattgaaaaatccggaagccggaacgcgaaaggattcgcgcgattacccgccgacgcgggcgggaaaggattgtcgtgtgtcgggtttcgcggaaggctgtggctttccagccacgcggcgcacccgtgggtgccggtttgcatcgcgctctggtagcctccgcgtctcatgagaccacagaagaatgaacagccggcggccgacgcgacccgcatcagccgaaccctcagctacctgctgcgccacgcgccgcaaacgatcgggctgcggctcgacccggaaggctgggccaacatcgacgaactgatcgccggcatcgcccgcctggggcatccgtcgatcgcgcgacgctcgaaaccgtctgcgcgaccaacgacaagcagcgcttcgccctctccgacgacggccgacgcatccgcgcggtacaaggccattcgacgcccgtcgtgcagcgccgctatccggccgcgcaaccgcccgagcgcctctgtcacggcaccgcgacgcgcttcctggattcgattcgggcgcaagggctgatacccggcgcccgtcatcacgtgcatctgtcgcctgacgtccggaccgcgctggccgtcggcacacgctacggcgtgcccgtgattctcgaggtcgatgcgcagcgcatgcatcggcagggccacacgttcttcgtcgccgaaaacggcgtatggctgacggatgccgtgccggccgaataccttacggagcgggacgcgcctgcacgctgagacgcgcggtcaccgcggccagaacatcgatgcgatggacagcgccagcgccgcgcacagcggcgagtaatacagtgtgtccatccgtgcgaaacgcgacccgcgaatccgcttgaagaagccgacgtaacggaaatcgccgacggcccgcaccgcgaagatcaatgcgagcacaacgaccgcgaacgagatcgtgccgggatacgggttcggccccagccagccggcacgcgcggcaaccacgcacgcaccgcccagcaatgccgccgcgacggcgagcgtgccgatggcggtcggccgcagcagcggctcgccgtcctgctcggaatggccgcacgcttgccgcgccgcccgcccaacgcccagtacacgtgaatgagcgcgatcgcgcaaagcgtcggcacgctgaaatacgccccggtcatgtcggtcaatgccctcgtctcgttgtgtcgttatctcgacgtgctgccggcgaagcgccggcacgcggccccgggccgcgacacgtgacgataccgaaacccggcagcacctgcattgcgacctccggtcgcaacccgccacgaccgatgttgcaacgcagtgcgcgcgggccggccgcttgacttccctccgcgcaccactaccctgttattccagtaccgcggtcgatacgcatccgcgcgatcggccgcacggcgcacctgcacgacaacgataacgaaggccatggaggcgactcatgctgatcggcgtgccgaaggagatcaagaaccacgaataccgtgtcggcctcacgccggccggcgcgcgcgaactcactcggcacggccaccgcgtgctggtgcagcgcggcgcgggcaccgcgatcggcctgctcgacaacgactacacggccgcgggcgcatcgctctgcgacggcgccgacgaagtcttcgcgcgcgccgacatgatcatcaaggtcaaggagccgcagccagcggaatgcgcgatgctgcggcgcgggcagatcctctacacgtacctgcatctcgcgcccgatcccggacaggccgcggcactcgtgaaatccggcgccgtctgcatcgcgtacgaaaccgtgacgggcccgggcggcggcctgccgctgctcgcgccgatgagcgaggtggccgggcgcatgtcgatccaggtcgcggcgacccacctcgaaagcccgcgcggcgggcgcggcctgctgatggccggtgtgccgggcgtgccggccgcgcacgtcgtcgtgctcggcgcgggcgtggtgggcaccggcgcgctgcagatggcggtcggcctcggcgcgcgcgtcaccgtgctcgacaccaacgtgaaccggctgcgccagctcgacctcgtgttcgccaaccggatcgcgaccgtctgctcgaacgcgcacacgatcgacgaagccgtgcgcgatgccgacgtcgtgatcggcgccgtactcgtgccgggcgcatcggcgccgcggctcgtcacgcgcgacatgatcgcgacgatgcgcaagggcggtcgtcgtcgacgtcgcgatcgaccagggcggatgcttcgagacttcgcatgcgacgacgcacgcggacccgaccttcgtcgtcgacggcgtcgtgcactactgcgtcgcgaacatgcccggcgcggtcgcgcgcacgtcgaccttcgcgctgaacaacgcgacgctcgggcacgcgctcgcactcgccgacaagggctggaagcaggcgatgaccgacgatccgcacctgcgcgcgggcctgaacgtgtgcgacgggcacatcacgtacgaagcggtcgcgctggcgctcggcctgccctacgtgccggcggccggcgtgctggcatgacgtgaccgccttctcgcacggcgggcggctcgcgcccgcctgccgcgttcatgcgcccttcgagccgcggcgcctggatgcgccgtccgctcccatcgtgcgtgcaagcagcggcctcaattgcgcgagcgtgcgcgtgttcagcacgtcgggccgcgtcagccagccgcgtcgcgcctgatcgacgccgtatgcgagattgtcgagatcgtccgtgctgcacgcatccgagccgatcgccaccggcacgccggccttcgcggcctcgcggcaccagatgtccggcaggtcgagccgccgcggctgcgcatcgagttcgacgaaacagccgcgcgccgcggcatgcgcgatcacgcgtgccacgtcgagttcgcatgcggcgcgctcgccgagcatgcggcccgtcgggtgcgcgagaatcgtgaaatgcggctggtccatcgcgtgcagcacgcgcgcggtctgcgcatcgcgcgacaactcgaagccgtcgcgcaccgcaccgaccacgagatcgagccggccgagcaacgcgtcgggcacgtcgaggctgccgtcctcgagaatgccggcctccacgcccttgagcagcacgaaatcgtcgaacgacgcgttcaggcggtcgatctcgtcgagttgccgggcaagccagtcgaagccgttgcggccgccgccggcatccggtgcccggtcggtgatggccaggtacgcgaatccgcgtgcgcgtgccgcatcggccatcgcgcgcaagctgtcgcggccggccgatgcgtcggtatgcgcatgcaggtcgccatgcacatgcttgcgctcgaccagcgccggtagcgcgcccgcgcgcgccgcgtcgatctcgccacgatcctcgcgcaattcgggcggaacttcgtgcagcccgatcgccgcgtacaccgacgcctcggtcgcgccggcaatccgttcgtcgccgcgaaacacgccatattcgttgatcttcagcccgccggcctgcgcgatcctgcgcaacgcgatgttgtgcgccttcgatccggtgaagtagacgagtgccgcgccgaacgcatcggcatcgacgacgcgcaggtcgacctgcaacccgctcgcgagcacgacgctcgacttcgtcttgccgtgcgccagcacgcgtgcgacctcgccgtagccgacgaacgcgtcggcgacggcctgcggatcgcgtgcggtgacgaggatgtcgagatcgccgaccgtctcgcggcggcggcggaagcttccggccggcacggccttgccgacacccgcaatcgcgcgcaggcgttcgagcagcggcagcagcgcgtgcgccgcatccggcagcaggaagcgttggggttcgcgttgcagccggtcgtcgatcgcttcgagcagatgggcttcggttttcgcgccgaagccgggcaattcacgcacgtgcccgctcttcgcctcggcgcgaagctgttcgagcgaatcgacgtgcagcgcgtcatgcagcgccttcacgcgtttcgcgccgagccccggcacgtcgagcagttcgacgatcgcgcccggcagcgcgtggcgcagcgtttgctggagttcgcaggtcccggtcgcggcgatctcgcgcagcttcgacgcgagatcgggcccgatcgacggaatcttcccgagatcgtcgccgttcgcgatcatcgtcgcgatatcgcgcccgtagtcggcgatcgtgcgcgcggcgttgcgatacgcacgcacccggaacggattggcgccctggatctcgagcatgtcggcgatctcggcgaacacggccgcacacccggcattgtggatcggcatgatcggcgtggctcccttccacgtggatggtgccgcgcgtgtgcgcgacgccgtctgcccgcgcggtgccgcatgccgacgccgccgggcgcacgttcgtcatcgtacgccggccgggcgtcgcgtgcagcgacgttgcggcgcgacgtcagagggtggcgcgcggtgtcgtggcgtagtgccgctcgtagatcgactggcaatgcgtgcagcgttcggcggccgggcgcgccagcaggcgctcgtagccgaccgaaccgtcgcagtcgatgcattcgccgtagctgccgtcgcgcatccgctgctgcgcgcggccgaccgcgcgcagttcggtcagtttcatgccgatcaatgcatgatcgacgtcgacgaacaggtccgcattcgcctcgtcgccctcgtccggcgccgcgccggcgagatctgcataggattccgacgcgcgctggtcttcgctcgtgcgtatctccgcacgtaacgtctgctcgctctcgttcagccgctgtttcagcgtctgccgttgttgtgcgtcgagcgccatggccgtctctcctgttccgggttccgcgcggaaaatggtcgcgcgcagtgtcgcgccggtgtgcggcgggcaaggttcgaccggcgccgccgcgccacggatacgcgcccggacgcatcaggcgccggacgcattcgatgcaggataaacccattgcacacgcgtgtgttgaccggaatcagcgtgccccgcgatgcacgtgaaggcttgcggaaactggggacggacgcgaaaacacgatgcaggattcacgccgcaacgcccgtcagcgcagccgcagcgcagcaattcgccgcatgatcgcgtctgtccttcggttcggcatcgatccaccgacggattggccggcgtgatttaccgcaccggacgattcgcaatcctcaaaaggcattccggccgatgaaccctcgcacgaccgtcaacaggatgatcttcatgtcgaaccagaagctccagttctgcatgtagaacaggtcgaacttgacgcgcgcctccatcgcctcgaccttgcgcgtctcgccgcgatagccgttcacctgtgcccatccggtgatgccgggccgcacgcggtagcggtacatgtagcagtcgatcagttgccggtaaaggtcgtcgtgttcgatcgcatgcggacgcgggccgacgaccgacatctgcccgaacagcacgttgaagaactgcggcagctcgtcgagcgacgtgcgccgcaggaacgcgccgacgcgcgtgatgcgcgcatcgttgcgcgatgcctgccgcacgacacccggttgtgcgcgatgcacgcgcatcgtccggaacttcaggatgtcgaactcccggccgtcgacgcccttgcggcgctgcctgaacagcacgggccccggcgacgacagcttgaccgcgatcgccagcatcgacagcagcggcagcaacggaatcagcacaccgaatgcgaacagccggtcgaacgcgaacttcgcccacagctccggcgccgagcgcggcgtggtcgcgagattgatcgccggcatgccgagcacgtcggtcgccgagcgatcgaccatcgccatctgccgcacatcgggcagcagccgcaattccacgaactcgtcgcgcaactcgcggacgatgcgctggatccgccactcttgcgacatcggcagcgtgagccatacctcgtcgatctcgccaccgcgaatcaggtcgcgcagtgcgttccagtcgtcgatcaccggcacgccgccgatgccgccggcggcagccggcgcgtcgtcatcgaatacgcacgccgccacgaaaggcccctgcggcgcgagctgcatccgctcgaccgcgacacgaccatacgccgtcgcaccgaccaccgcgacgcggcgctgccgcgcgcgcgggtcgtcgcgcgtcagtgccagcgccagcagcgcggcacggcccagcagcagcgccgcgtcgccggccagcaccgtgcgcgcgatccagcgcgtcgtgatcgtgccgccgcggttcatgatccacatcgcggcgcccaccgtcagcacgctcgcgcagacgagcgccacgatcgtctgcgtcagcgcatgcgtgccgccttgcggcgccacgctgccgcgcacggtgcgcaggtagcgcggcagcaacgccacggtcagcacgcacagcagcgcgatcgcgccgcgctgcgcgtcggacagcgcgcgccacgcgaggcccgggccgcctgcgccgcgagcgcgccggccagcacgagtacggcgtcggtcgctgcgatcgcggcacgccgcatcgcattcgttccaccgaacctcggctgcatcgtcacgcaccatgtgcgggaacccgcgatgcccgtccggcatgcggggccgaacgggtgtcggcctcgccgtctcgcgggtgccgagcagcctgcgatagtcggcgcgaatcaggtcgtagcattcgcacgcgtgatgttcgaggccgtcgcggtcgagcaccgtgatgcggccgcggcgctgccggatcagtccggcttcctgcaggttgccggccgcttccgtcacgccttcgcgccgcacgccgagcatgttcgcgatcgtctgctgcgtgaccgccagttcgtcgccgtcgatgcggtcgtgcgcgagcagcagccagcggctgagctgctcgctgaccgagtgatgccggttgcacagcgcgctgcgcgagatctgcgccatcgcggcctggcagtagctgagcagcagccggtaggtcgccggcgaacgctcgaattcggcgcgcatcacgcagctcggcacacgataggccatcccgccgatgcggacctcgatccggtgcgacgccgcggcgccaccgaccagcgtcgccagaccgaccactccctcgcggccgacctgcgccacctcgaccatcgcaccgtcctccatcaggtgctgcaccgacatcatcgacgtcgtcgggaaatgcacgtggcgcatcggttcgccgacccgctcgagcatcccggccttgatcctgaccagttcgagatgcggtgcgatggtgcggatgctgtcctccgggagggcatcgaggatggcattcgccgagtagctcgagtgaagatgaagcatgtctgtatcccttttatcgttcgcgccgcttgcagccgcgggcacggaactcgttatcgcgatgcgcgcccggacgtcggcggtggttgcggcccacaaccctgattccgaccgaccctcggctcatcgccgccggatcgaatcggccgtcccgtttcgacacgccagcccgaataagcgatttacgtgccaaaccttgtccatccttaatatgtgaatcacgcccgatttagatcgcccgaattaccggctcaaaacccaaaaagcgtctcatttccggacactcttccgggcgccggacaccgcaagccatttgactgatcatttccctgcatcgaaccaagacagatacggcggggctgccaggcttgtcgctcatatacttacagtcgattttcaattgtttccgtgatgtgccctgcagcacttcgctgcggcatcatgtctcgcacggccgtttgaaactgtctcaaatttgaatcgacacactaaattcagactctgttacctgacgcacatttcgctcatacgcaattgatttttatggatatttttgcgagcgtcattcgattgtcaaataatgttcaatgtccgcccggcactttctccgcacgaagcacggcaccgttcgattgattcccgttcgacatcgaatgaatgtcaaacgtcccattcgatttccggatgattaattccactaaaacgaatcattaaatccggataacattcccgcccgccaaaaatcgtcaaactttgtgaaatgacgcaatgtgcaattgatcgaattcaatggcgtgttagccttttcgcgagtatcgtcactccatttctgacgaacacaagtccgcacgatcgtgcgaattccccattttcggggtatcgccgagacgacgcgcgaccgccaccctacgaggatgcgccgtgactcaccaggcccctgacaccgtcgcgtacgcgaacggtatgatcgagctttctcacagcttcgatgcgaaccggtttctcgcggccgtcgaccgcgatgaacttgcgacattcgcccccaccttcaacttgtccacctgaaatcggggcaagtgctctgcgagcccggcgaaatgctcgccgcggtctacctgcccgtcacgaccgcgatttcgctgcagtacgtgtcgtccggcggcatgacgctggaagtcgcggagatcggcagcgagagcgtggcgtgcgacgacgtgatcggcggcagcggccggatgccctgccgggcagtggcctgccgcgacggtttcgcctaccggctcgaccggcgcgtgttcgccgccgcgttcgacgcgtcgccggtcattcgccatctcgtgttcgtctgcgtgcggctgctgatggcgcaggtctcgcagatcacgttctgcaaccgtcatcacgtgctcaaacatcagttatgcagatggttcctgctcgcgtatgaccggacccgcagcatcgagatccaggtgacacacagcatgctggcgcagatgctcggcgtgcggcgcgaaacggtcaccgatgccgccggcgagattcagaagctgggcctgatccggcaataccggagttcaatcgagctcgccgacctcgacggtctcgagaagatgtcgtgcggctgccgcgcgatcgtgcgtgacgagatgaagcgcatcctgtcggccgactcgggtgtgccggccgcttcgcgcgcctgacctgcctgccccgcctgcccgcgcggcgcttcggcgctgcgcttcctcggtacgcagggttagcggtttgtagggtggcgaacagaacgccgtgcctgccaatggtctactgatgccggactgccgggggacgtcagcgcgtatgccgcgtctgcccgagcggacgacaccacgcacgccggagcagcacgtgaaaaacgaaatcagaaccatcctcaagcacgtcgcccacctcgaagccgcgatcgattcgatcggcgacggggacgacctctacgaagcgggcctcgtcgctcgatacgatccagctgatgctcgcgatcgagaagcaattcaacatcgagattcccgacgagatgctgaaccgcaacctgttccgcagcatcgacgcgctcgcggacacgatcgccacgctgcaacgcaccgagcattccgcatgagcgcgctgcttcccgaactcgcgaccgacagcgacgcgcatcggctcgacgaggccgcgcatgccgtcgcgcagatcgccgcgcagcacgcggacgcggtcgaccgcgacgcgcgctgccccgtcgaggcgatcgaggcgatgcgcgcgcgccgcctgctcggcgcaatggtgccgacccatctcggcggcgctggcgcgtcgctggaggacatcgcgtcggcctgttcgattctcggccaggcctgcgcgtcgtcggccatggtgttcgcgatgcaccagatccaggtcgcctgcatcgtcgaccacgcggtcgaccagggctggcacaagctcttccttcagcaactcgtgcgccaccagtggctgctcgcatcggctacgtcggaaaacggcgtcggcggcaacctgcgcgcaagccagtgcgcgctcgaaaccgacaacggcgagttccggttgcgcaaatccgcgccgacgatctcgtacggcgactatgcggacggcatcctcgcgaccgcacgacgcgatgcggacgccccggcttccgagcaggtgctcgtcacgctgctgcgcgacggctacacgctcacgcgccgcggcgaatgggacacgctcgggatgcgcggcacctgcagcaacggtttcgagctcgacgcgcaaggcgccgccgcccagtgcctgccggtgccgttcgcgaagatcgccgaggaaacgatggtgccggtgtcgcacatcctgtgggccgcggtctggatcggcgtggccggcgacgcgttccatcgcgcgcaccagttcttccgcgcgcaggcacgccagaccgacggggcaccgtcgcccgcgtcgcgacgcatcgccgaatcgctcgcgctgatgcaggccatgcaggcccgcgtcgacaacgtgctgcgcctccatgcgaatgcgaccgcgcgctcgtggtcggccgggatggcctgggccgccgagatcaacacgctgaagacctacgtgtcgacgaccgcgctggaagtcgcgcaccaggccatgatgatctgcgggatggccggctacaagcaaggcacgccgttcagcatcggccgccacattcgcgacctgcatgcggcgccgctgatgatcagcaacgaccgcattgccaccaacacctcgaacctgctgctcgcgctgcgtcctgcgacgctggagaaacatacgtgaacgatcgccttgccgtgccctccgccgcctccgctcccgccgacgcaccgctcgaccgcgcgggcgtcaacccgctgcgcgacgaactgatcgacgcgggcctgctggtctcgaccggcattcaaggcctgttcggccgcagtgaacggttcgagcgcgtcgtggaagcgctcgacgcgttcgtcacgcgcatcggcgccgaccagcaggccgaagtgctgcgcttcccgccggccatgagccgcatcgagttcgagcgcagcgaatacatgaagagcttcccgcagctcgcgggcagcgtgcatgcgttctgcggcgacgaacgccagcaccagcgcgtactgcagtgcctcgatcgcggcgacgactggacggaaagccagaagccgacctatgtcgtgatgacgccggccgcgtgctaccccgtctaccctgtcgtggcgcgcgcgggcgcgctgccggccgacggccggatcgtcgacgtattctcgtactgcttccgccacgagccgtcgctcgatccgacccgcatgcagttgttccggatgcgcgaatacgtgcgaatcggcacgcccgagcagatcgtctcgttccgcgagacctggatcgaacgcggcacgcggatgatcgaggcgctgcgcctgcccaacgcgatcgacctcgcgaacgacccgttcttcgggcgcggcggcaagatcgtcgcgaacagccagcgcgagcagaacctgaagttcgagctgctgatcccgatcgagcacgacgatcgccagaccgcctgcctgagcttcaattaccacatggaccatttcgggctgctgtggaacatccgcaccgcgacggacgaggtcgcgcacacgggctgcgtcggcttcggcctcgaacggctcacgctcgcgctgttccgccaccacggcttcgacatcgatgcatggccgcgtgaagtccgcgacgtgctgtggggcacgcgatgagattcgtgtcccgcgacggcgaagacgcgtcgttcgaggatgtgcgccaccgtgcgcgccactaccggccgcatccgctgcacagccaggagatggtctggaagcagaccaactgctacgtcgacatgtggctcgaagtgctccggtggtggggcttcaatccgtacgcggcgctgccgttcacgatcgcgctcgatttcgagggcgaccagttcacgttcttcaagtttccgcacgacgaactggagcggctgtacggcatcgtcgtgcaggagcactcgatctacgaaccgctcgaccggcacatcgagacgcaggtcgcgcgcggtcacctgatgatcgtcgaagtcgacgcgtggttcctgcccgatacgcgcggcagcagctaccgtacgcagcacacgaagacgacgatcggcatcgatgcgatcgaccgcgcgaatcgccagatcggctacttccacaacagcggttattacgtggccgaggatttcgactacgacgggctcgtcggcggcagctcgccgatgacgctgccaccctatgtcgaatgcgcgaaacggcggtttgcgccgctcgacgaacgcacgctgtgcgagacgtcgctcgccgcgctgcagcgccacctgcggcgcttgccggtggtcgacccgatcgccgcgttccggcggcagttgcagaccgacgcgcggacgctcgccgattcgccgctcgagcgctttcatgcgtactcgttcaactcggtgcgccagctcggcgcgaacttcgagctgttcggccattacgcgcgctggctgcaggccagcggctgcgtcgggccgttcgccgagatccgcgccgcgtgcgaccgcatcgcgtccgaagcgatggtgctggaattccggctcgcacgcgcctgcgcgcgcggcaaggaagaacgcggcgattcgacgctcgaagcgatcgaggccgcctacgcggacgtggtcgcgtgcgcgcggcagatcggcttgccgctgcggcacatgacgcccgtgcacagcgacgcggcggcacccgtgccggtcatgcggtgacgcgcacgcgccctgcccgcgtggtcgatgctggcgacggccgcgggggccgcacgggaaccgcgcgatcttccggccgccggcaacggctggattccggcggccgtgcccggtaccgtcgcacagtcgctcgcgctcgccggccggctcgacgaagccgtatcgctcgacgagcgcgaccactggtaccggatcgaactgcgcggacacgggccgcgcgtgctgcgttttcacggcctcgcgacgctcgcgcaggtgtggctcgacgacacgccgatcctccgctccgacagcatgttcgtcgcgcacgacgtgcccgtgtcgctcgacgggtcgcaccggctgacgctctgtttccgcgcgctcgccccgcacctgcgcgacgcgcgcgccgcgccgcgcgcgctggcgcacgcgcctcgcggagccggcggccctgcgcacgatccgcacgtcgctgttcgggcacatgccgggctggtttccgccgcatgtgccgaccggcccgtggcggcccgtggacgtgctcgatccggccgacgggcccgttctcgccgattgcaacctgcacgcgcgcatcgaaggcgacaccggttggctcgacgcggacctgacattcgccgcgccgctgcccgacgcgctcgcggcacggctgtcgtgcggccagcaccacgccacgctcgaacgtgcgggccccgatcgcctgcgcgcaagcgtcgcggtgcccaacgtgtgccgctggtggccgcatacgcacggcgagccggtgctgtacgacatcgcgctgcatatcggcgacgagcgtcggccgctcggcgcgaccggctttcgcacgatcgaggtcgaccccggcgccgacggcaagggcttcgggctgcgcgtcaacggcgtgcccgtgttcgcgcgcggcgcgtgctggagcagcgccgcgccgctcgcgctgcacgcggacgacgccacctacgcccgcctgctcgggctcgcgcgcgacgccggcttcaacatgatccgcgtcggcggcacgatgacctacgaggccgacgcctttcacgcgtggtgcgaccggctcggcctgctggtctggcaggatttcatgttcgcgaacttcgactacgcgctcgacgatcccgcattcgcggacaacgtcgatcgcgaggcccgacagttcctctcgcgtcacggcgcatcgccgtcgcttgccgtcctgtgcggcggcagcgagatcgcgcagcaggccgcgatgtcgggctcgggccgaagcagcgcttcctcgagctgaccgccgaccggctggccggccatgcggccgcatgccggcccgacgtcccgtacgtgcccgattcgcccgacggcggcgtgctgccgttcatgccgcgcgaacgcgtgtcgcactattacggtgtcggtgcctacctgcgcccgctcgatgacgcgcgccgcgcggacgtgcgcttcgcgagcgaatgcctcgcgttctcgaacgtgccatgcgacgcgacgctcgccgagctcggctggcccggcgtgcacgagccgcgctggaaagccgccgtgccgcgcgaccccggcacgtcgtgggatttcgaggacattcgcgaccactatctgcagacgctgtacgacgtcgtgcccgaccggctgcggcgcgaggatccggcgcgctacttcgaactgtcgcgcgcggtagtcgccgacgtgatgcgcgagacgttttccgaatggcggcgcaccggctcgcgctgcgccggcgcgctggtctggcagttccaggacgtgatgccgggtgccggctgggggtaatcgacgccgcgcaccggccgaaatcggcgtggcatgcgctgcgccaggtgctgcaacccgtacaggtgctgctcgtcgacgaaggcctgaacgggctcgacgtgcatgtcgtcaacgagcgccccgcgccgctgtcggcggcgctcgaactggtcgcgctgcgcgacggccgcacggcggttgcacgggccggctgcccggttcggatcgccgcgcacgacacggtgcggatcggttcggccgagctgctcggccgcttcttcgactggacctacgcgtaccgcttcgggccctgcgaacacgacaccgtcgtcgcgaccctgcgcggcgacgacggcaccctgctgtcgcaggcattccatttccgtcccgtacgcatccggcggtgctggcgcgccgcgaactcgggctggaggcgtgtgtgtcgcgcaccggcgacacgtggcacgtcgacatcgatacacggcacgtcgcacgccatgtgcagatcgatgcgccgggattcgtgccgcgcgacgactggttccatctcgcgcccggcacgccggcgcgcgtggtgctcgttccgcttggaacggccgggaagaatggggccgcggatgggccgccggccgtggaaatccgcgccgtgaacgccgcgcgcggtgcgcgccacgcaggccggttgacgcggcgctcgcggccgcacaagccgcgagcgccccggtcgaatctcagtcggacgagcccgtcccgcgcggccgctcgatcccgtatgcctccatccagcggtacagcgtcgcgcgcgacaccccgagctcccgcgccgaagccgcgacgcgcccgcgcgtgcgcagcagcgccgtttcgattgcctcgcgctcgatcgacttgcggatgtcggccaccgacggcgacgccgcatcgagacagtattcgagttcgagatcctgggcggtgatcaggcggccttccgtcatcacgaccgcgcggcgcacgcggttgatcagttcgcgaacgttgccgggccagtcgtgcttgtacagcgccgtgatcgcatccgtcgagaagccgcgcacgcggtggcgcgcgtcgccgcggaagcgctcaagcatgtgatgcgcgagcagctcgatgtccttgccgcgcgcgcagcggcggctggtcgatgcgcatcacgcacagccggtggaacaggtcggcccggaagcgcccttcctccatcgcgtcgcgcaggtcgacgtgcgtcgccgacacgatcctgacatcgaccggcaccggatcgctgccgccaaggcgatggattgcacgctcctgcagaaaacgcagcaagcttgcctggctctcgtgcggcaggtcgccgatctcgtcgagcagcagcgtgccgccgttcgccgcttcgacataaccgatcttgcgcgcgttcgcgcccgtaaacgcgccgcgctcgtagccgaacagttcggattgcagcagatgtggcggaatggcgccgcagttgaccgcgacgaacgggccgttgcggcgctccgaatggcgatggatcgcgacggccgtcaactccttgccggttcccgtttcgccgaacacgaacaccggtgcgtccgtgcgcgcgaagcgccgcaccgtatcgaacagccgcagcatcgcgctgcaggtgccgacgatgcctttctcttcggattcgagccgttcgcggtcgcgcgcgaacaggcattccatgccgtacgcatggccgaccgtatcggcgatccgctggtgcgacgccggcaacgtgacgtaatcgaagcaatagtcgcgcaacagcgcgcgcacgttcggcgaagccgtctggccgacgtcgacgagtgcgacccagacgacgtcgcgcatcgacgcgcaggtcgacgcaatgctgccgatcgcgtcggcgtggccgccgctcaggtcgaggatgccgcaggtgatctcgccggatgtatcgcgcagctcactcgcctgcgcgacgatcgacactttccagtcgcgtcgcgacagttcctttcgcagcatgacggacggcgactgcgtccagtaaatcagcggacgctgcccgttaccactcccgcgccggcgctcttatcgcgcgttattggcatattcataacgaaccatcactttctccactccgcgaaccgttcgcgtgcgctgcggccggcggcgcatggccgccttccgcgctgcgtttccgcagctttggcgaagatcgaaactgcacacggcgagaaccccggaggtcgagccggatgtcatccggcctcgttgtcatctaactcgaagggaacgcgcggctgcgggagccacgacgttcccgctttgaagcgacccgccgtcaaggcggagcgcgtcggcagacgggaatgccgccggcatgtgcgtcacgtcgtacacgacaatggcgcccgacgccgaaccggatggccgccaacccgctcccggaatgactgccgcatttcatccgcatctgaatttacaccccgtttcgagatggtcgtgttaccaaaagataatcctgaatcaaccggttacgcgacctgtcgcaccgcaccacacgtgtttgtgcactgagatttgattatctacgagcattccagtcaatcagtggcaaatactacttttccgcaagatggggacggtcgattgcctgtgatattcatcgaaatccccggaatgggcggcaccacatttcattttccacataatcgggcccaccggcggcaggccgcatcgtatcgcgaccgcatgcggcctgcccgtcctgctcttgtcggttacatgccgtaatcaaccacgccgcgtcgtgcatcccgttccgctgtgccggcgcacggcgaaacgcccgccgcgcacgccggtcttgttccggcgaatcgccgcggccaagcgtgatgccgatcgtgccgaccgccgcctcccgcagtgcagcatggcgacgcccggtcgcgtcacgcccgtgcactgcattccatctgtaaggatgcgggctgcccgttgtcgcagtcggccatgccgcaccgcctggtcgccagccgcggcgacgacgcatcgccgcgggggcgcatgcgtgcaaacaatggcgtggggatgagggacgcgtgtgccgcgcgggcgcgcacgatccggaaggaattcgacgaggctccacacggtctgcccatgcgatgcagccgaccgcgtgcgcgagggtgcacccggcaccgccatgcacgatcgccccgtcgtgaatgctcgaaatcttcaagtcctgccccggttctttattgacgttcgatgttggctggccgcgcatcgaggcgggccgcgacgatgggtcaattatggaaaagcaccggccgccgcggtgtgtgctaccgcactttgcggcgctcgcgcggcaggccgcgccgtgcatgccgtgccggccgcgcgaatccggcgagagtacgctttcgaacagaccggcgcacggcgcacccggatgatgagaatcgccgcaccgcacggaacgatcgcgtccgcgcggcacggcgtgccgaaggcatcacgcgaggacagcatcatggaatggcattgttgtgaattcgaacatctgggcgccgtcgatctctatgcaatcctgcgcgcgcgcaacgccgtgctggtggtcgaggacgcgcacacgcatctcgacatcgacggcaaggacgcgggcgcgctgcatgtctatgcaaccgtacgcgacggcgacacgatggaagtcgcggcctacgcacgcatcctgcccggcgacgacatcgacccggacgccgtgatcgacaaggtgctgacgagcgagcgccggcgcgacgacgctacgctcgagcagcgatcgggcgcgccctcaccgccgcgcaggcggcatggcccgacgccgcggtgcgcacgcacgtcccggcaccgcgccaggcgttctacaagcgtttcggatttcgcaaggcctacggcccgtatctcgaacagggtgcgccgttcgtcggcctggtgcggcccagcgaccgcgcagcaggcgcactgcgcggcctgctgcaccgggtcgtttcggcacaccggtcgcgcgacgacgacgcacgtgccgacagccgtacacacaaccggctgcccgccgacaccggagccaatcgatgacccgcacccttcgcccggttcccgatcccgacctgccgcgcatcctgccggtgattctcgccggcggctccggcacccggctgtggccgttgtcgcgcgagcagtatccgaagcagttgatcgagctgatttcgaacgaatcgccgctgtcggcgacggcgcgccgcctgaacggcatcgcgaacgcatcgctcggcgacacgttgctgctggtctgcggcgaacagcatcgcgtcatgagtgccgcgcaggtggtcggtcgcgcggcgcccgcccgcatcctgctcgaaccggccgcgcgcaacaccgcgcccgcgctgacgctcgcggcactcgacgcgagccagctcgcggacgatcccgtgctcgcggtgatgccggccgatcacgtgatcaccgacgtcggcgcgttccaggacgcgatcgcgcgcgcggcgcgctacgcgcaggaaggggcgatcgtcacgctcggcgtgctgccccgacgcgcggagacgggctacggctacatccaggtcggcgagccgcgcacgggacgccacggtggccagggcggctacgcgatcggacgcttcgtcgaaaaacccgatgcgacgctggccgagcgctacctgcaatccggcgattactggtggaacagcgggatttacgtgacgcgcgcatcggtctggctgaaggcgatcggcgcactcgcaccggacatccatgcggcctgcgaaaacgcgtggcgcgcgggcatccccgaggatccgttcttccggatcgatgcggcggccttcgacacgtgcccgtcggactcgatcgactacgcggtgatggaacggctcgcggagcacggcgaactcggcatcgaaggcatcgtggtgccgctcgcggccggctggtcggatgtcggtacctgggatgcgatctgggaaatcatgccgaaggacgatcacggcaacgtcgcgcgcggcccgatcgtgttcgaggacacgcaggacagcctcgtgcgttcggagggccgcctgatcgcgtgcgtcgggatgaaggacgtcgtcgtgatcgagacgcccgatgccgtgctggtcgcgaacaagcatgacgtgcagcgcgtgaagaacatcgtcgagcgcctgaagaccgaccggcgcccgcaggcgcgcgagcaccgcaaggtgcagcggccgtgggggcactacgattcgatcgatctcggccagcgcttccaggtgaagcggatcgtcgtcgagcctggcaagcggctgtcgctgcagatgcactatcaccgcgccgagcactggatcgtcgtgcgcggcaccgcgaaggtgacgcgtggcagcgagacgttcctgctgtgcgagaacgagtcgacgtacatcgcggtcggcgaagtgcatcgcctcgagaatcccggccggattccgctcgaaatcatcgaagtgcaatcgggcgactatctcggcgaggacgatatcgttcggttcgacgatcagtatgggcgggcggtcgaggcgctgcctgcccgacagacatagtcgatacggcgcccgcccggatctcacttgatcgatcaacctggcggacgacgccgttcgccgtgcgcgttccgccgtcaatcgacagcaccgggcaatcaacgaggctgccacgcgaattcgcgaacgcgcggcagtaacgacatatccgcaccgactacatcgggcgtaaccagccgggtttgaagcgccatcgcgcacggctcggctttcgcgtcgccgacagcgcaatcctgcttcgggccaacccgtaccggcatgcctccgatccccgacaattgattatccgcaagccggaccccagacacgtttccccacacgcgaatgccgtcgaagcgcgcttgcgatacgcggttgccgatcacggccacttgcgtcaccgtaccggaccacgtgctgacctctatcgctgcctgctgcgtgagtgggcgcggatcggtccggccggtcaccgtctggatattcgcaattatgttgttctcgatccggacaccggacgcgccgtaggtctggaagctgtcttcctgcgcgacgagaatcccggagctcacctgcacgttgcgcacgacgttgttcgagatcgtcacgtccgcgccgccgaccaccgtgattccgcgccccacgtgttgccttcgagcgagttgcgcgtgatgaagacgttgcggctcagcacaccatcgccccggtagctcaccacggcaatcatgtcatccccggtgtcacgcacgacattgccttgcaccagcacgtcacgcgcgccatgcgtcacatgaatgccgtcggcgagcgttgacagtacctcgtttccaacgatcgcgacgtccgagcctccaaacacgaaaatgccggcgctggcaccgccttcgatcacgttgtcgagtacttggacgtcgtgccccgtcacctcgaccttggtcgactcccgcgtcgccaggcgcgtcgtgccggttcccctgagccgaaatccgataagcgtcgtaccgtcgccccgcatctcgaccgtctggtcacccgggcgggttgccatcagcgttgcgccgtaacccgacagcacgacattcggccgccgcacgatcagtgaacgaccgatcacataccgccctggcgcgaacaccagtcgctgccccggacgcaacccgtccagcacgcgttgcaactcatccgcctgatctgctcggccggggcgggataaacgtatgcatccggtacgttcgcatgcagcgcacctgaggccgacacgtcggatgccgccacgacgatcccgggccacatcaatccgccagccatcaggatgccggcgatcacggcgtacgcgcgagactggcatcgtgaaccatgcatatcgaatcggttccctggaaaaatctgatgcacggggctgccccgtgcgctcgaataccgctgccgcggccgacgtggttcacgcccgctgccgcgaaatcgattgcttctgcggcgacgacaacaagctacatccttgccactcgttgaccgccgggcagatcggcgatttcgtcaaaacggacgaggtaatgctttccattggaccatttgatcctgctagacctcggtgcgccagcacacctagatatgcagccccatctcttctgatgccgcgacattccacgaatcgttacgcggacatagcgcgaatctcacaacgacgaaccgctcggtgaatgtcgtcaacccaggcggcgatcgattaattccttcgtcggtaagccatcgcacccagcgcgtcgcgcatgcgctgcacaatgccctcatcgtcaaacgcgcgccacgacaggcgcttgcggttgcgtgatttcgaggacggtggcccgaggcctgccctcgtcgactctaccgtcgacgccaacggatcatccacctcaatcccaacatgatggattcaatacgcgcaattttcatgaattcatgaattaggaatccatatttcactgagccggatgtcgcgtatgcgcgacccgccggctatttgacaatccgccgtccaaccactttcacggcaatcgatgaaaaacgcgatcgaaccgacaggccgaaagatgaccacaaagaagatcgttcatattgccgaggcgtttggtggcggcgtgctttcgatggtgaccctgctagccaatcacgccgcggcagccggcgtcgatgtgacggtactgcactcgattcgccccgaaacgccggccgatttttcaacgttgttccggcctgacgtgaagctgatctacgtcgacatggcacgcgaggtcagcatcaggcaggatcttttgagcgtgcgcgcgctggccaggattcttcgcgactgcaagccggccgcgattcatctgcattcgtcgaaggcaggcgtactcgggcgtctcgcgtcgagaattgccgcgcccaatgcgacggtcctctattcccctcacggcctttcattcctgcgcttcgatatttcccgcatgaagcagtttgcctatctgaacttcgaacgcatcgcggctcatatcggcggaaccattgtcgcgtgctccggcagcgagctcggtgagatcaaggaaaaagtccatgcgaaatcggcagttctcgtggaaaacggcgtcgatgtcgccgagatcctgccccgccgagcacgagacgatggcaagacagtggttggaatgagcggtcgggcatcgttccagaagaaccatcacgcattcgtcgagctggccaccaaactgcagcgggctgacgtcgacttcctgtggatcggcggcgacgccgacgagattcggatccacgccagagcacggccgtcatctgcagcggctgggtgactcgagcacacgcgctggcactcacgtcgggtctggacatctatgtccagacctcccgctgggaaggcatgccggtcgcattgatcgaagcccaggttgcgggcataccggccgtggtgacggacgtcgtcggtaatcgcgacgtggtgattcacggcgtaaccggatatatcgcatcgaacgtcgacgagatggccgtgtatctgaccaagctgcgggacgaccggcaacttcgcgaaaaatgggtgcggcagcgcgcacgagagcggttcaaaggttttcgatgaacacggtcttccggcagtggcacatgctttatggcctggacgcggtcgattctcacgccggcactcgcgacttcaagccggtcgccctcgaccacgtcaaagcccgattctgagttcaatgtccaatgattgacatgaccgccttcaaaaagtcgaaacatctcgtgtacaacggtcgattcaccacgcagaagacgaccggcgtacaacgggtcgcacgcgagctgatcgccgcgctcatcaagtttcagcctcaagaaccggtgaccctccttatgcctccacagcccggcgtagaggtgaacggcgcgcggaccgtcaaggtcggtttttacaagggtgccgtgtgggagcaactggtgctccgtttttcgcccgtcccggtcggctcgtcaatctcggcaattccgcgtccattttcatccgcaaccagatcatctacatgcacgatgcggcggtattcgacacgcccgcccacttttcgcgttcgtttcgggtgtggtaccgaatcatgttctggatcctggcgcgaacctccgcttgcgtgctgaccaactcctatttttcacgggaccgcctcgcctaccactgtggcatctcgaccgagaaaatcagcgtcgttccgcttggtgcggatcacctcgactcgctgaagcccgacacgagcgtgctcgacgcgcactcgctgacgccgaaccggttcgtgctcgcggtcagcagcatgaatcccaccaagaactttggccggctcatcgcggcatttcggcagatcgacgatccgtcggtcgacctcgtcatcgtcgggatgagaaacaccaccgtgttcggaaaccaggatcatgtcttggcggcagaaccgaacatcaagttcgtcggctatatcagcgacgagcaactgaaagcgctgtaccaaaatgcggcatgcttcctttatccatccatctacgaaggtttcggcatccctcctcttgaagcgatgcgctatggttgcccgacgatcgtcggaaaagccgcggcgctgccggaagtctgcgccgatgcggcgctgtactgcgatccgtattcgcaggacgacattgcggaaaaattgcggcgcgtgctgggttccgacgcactcagagccgagctcagacggaagggaaatctccacgcggaaaaatactgctggagcaaaagcgcaaaaatgatgacggaaatattcgaagggctgtaggcgatcgaagcaagccgtcgcttcgacggaggattcgcaccggcatgatccggcgcgctcactctgacggtcgtctcaaccaagactcgcgccgtcaccaagccctggaatcatggaaagggtcggcatttgcgcgccgaggcaaagaagttcatgaccaagcccccgattcgactagcaaatactcgaccggaaacctgattcgcgtatgtcacgcggctgaatcaccagtgacgcagcatccgatccttgcccatacttgcgatcatggcgcgagcagcccttcgtgctctcggtagaggacaacgaaccgtcgtcgccgcagaccaacctgttccgtcacgagccgcatcacctcgatcttgccggtatgttgatcaggccaacccgttcacggaagagcacgtacataagtacgacggtcacgatcgtttcgaccatcaacaccgcgatcgccgcgccacgctccgcgaatagcgaggcaagcggcggcagtatcgtgacgttcagcaagccggacgagatcaggatggtactgaaaacgcgcttcatgccgagcggcagcatcgtctggattccgaatagatcggtcatgcatgccatgaacggcaccagcgcaagacaacgcagcacgccaactgtcggcccgaacgtgtctccgtacaggatccggaccgcgagcggcgcgaactcgtagatcaccgccgacattgcgagcactagcgcaccctgcacgacaatcagcttgcgaaggaacgcgaacgcctcgtcacgtgcgttatgcatcagataggtgatatgagggtaagtggttgccctcagcggctgcaacatgccgacagcggcccggatcagcttgtcgcccgcggcaaaatagcctgcggccacgtgaccggaaacgatactcagcaggacggtgttggtcgaggcgtagaacgagattgaagtcgatgcgaggaagacctgcgtgccgcctttcaatgcatcgacaatatccgcgaaccgcacgcggacacgcgcgatctcttgacaaaagaacaggtaagcaagcgaggtgaaaccgcagagcaacggcacggctgcattaatggcgaccgcatgaagaatatcgtccggcgtgtgaacccacaggaagaaagcgccgacgctcagtgctcgatacccgaccaccgtcatgctgaacacgctcagcttctgaatgccctgaaagtaccagcctggcgtgagcgcggcgcctattgccatcccgaattcgatcagcagcgccgtgcgctccgcttcgaagtacggaatcaacgacgtcatcgcgacgagtaccgcgaagcccgcgacggttatcagccactgggcgctgatggtcgtccagaaaattctggaccgctcgatcttgtcacgcgcgagcgcgacgcgcggcgtcgccgtcaggtcgaagctgtaatttaccagattgatgaaatacgttgtcaccgcgagcacgaacgccagccttccgtactgttgagggcccagcacacgggtcaagagcggtagcgtgacgagcggcacgacatacgtcgagatctgcaacgcaaacaacatggcgaagtttttcgaacggcggtcatcgtgctttctgaagtgaaaatgggtagtgcatcgactgtcagcaggcacgcgtgcgcggtacgggctcgtcaataccgagcgcggcatacagcgacgatgcgtagcaatcgatcgagtaacgtgaccagtcgtagtgacgattttcgtcggcgaggtgcgtgcgtagcgcgtcgattgcgcgggagaaatcttcgggaagtttcgatagaggatcttgttgccgatttcgtcgccgaatgtcgacagactgccgatatcgttcacgagcaccggcaggccgagaaccgcggcctcgactatcacgagggggcgttttccacccagatcgatggaagcacaagcgcgtcgtgcgtaggcagttcggcgaaaagcgcggcgtgatcgagacggccggcaaaacgcaaccttccggctttgacgaggtccgcgtggcgttcctcgagaggaccgcgctccgatccgtcaccataaacggtaagcgattcgatcgcttcgccggcggaatcggccataagcgcgagaaactgagccagtccttgtccgcttcaatacggccgacgaacgcaagatccaggcgagcgcgctgcgcaggtttcggcgcgtgcggaaccaatgccgaatcgatcggattcgatagaagcgtgacacgggttcgcccgaatcgcccgatcaggtcgcgcatgaacgggcttgggcagaggatttcatcgaacaggccaagcgggtcgaaaagtgcattgaccgtgtgccaatgcaacttcttaacgacgtcgtggaaaattccgtgcggactggcgacagagacgatgcgtcgggcactgtgcagctggtccagcgacaatggtttcgtctgcccgcgggaataaatctgcaggctcggattgtagaacacgagatggtaatcgtgcgcagtcaggtacaaactgcaccccgagcgccgcttgtagcgggcaagcacgggcaagatcgcgctcgacagcagattgtgataattgtgtaccagaatgcgttgtggccgaaaccgatcgagctgcgcgacgagcgcacgcgcagtcgcgcgcgaccatacacgagcgcgccgaatattttcgaccgcgggcagcgcatgctcgtcgaaggtttcgaccgtcacgtcgttgcgcgcgcgcagcacgtcaacggacattcggtacacctcctccgcccctccccttcgaacgaagtcgttgatgaccagcacgcgcatcacgcaggacctcgacatacgtgatgccggaagctcgacgcatcgtcatcgtcttcgcgtcgcggcgagatctgcacggtgtcgcaggccgcttgcaagcagtaaattttgcgcaatttccggcagtcgtggcaatttcgtttcatggatattcctgagcggaatcacggcgccacgtacgtccggcaagtggccccgtgacacactacgtcgcaacgataacgtaccgagaatgacgaatctgttcgcatggtcactcagagccggtttcgccataccttcccggtgtgcccgcgaacgttcctcgcaacgctcgaaacgaataccgcgatagcggcggcgacataacgctgcccgccccaccgacaacgataaggctgcggcctagctgcgaagcgtcaagaggttgtttctcgacgcgggcagtctggccatcggcgcaattccgccgatggcgctgtgggcacgatgccggttgtggtgatgcggccagcttgcgaaggcatcgctgcggtgggcggagctttggtatgtccaggcgtatgcccactcgcgcaaggccgattggatgaactgctcagccttgccgttggtctgcggacgatacgcccgtgtaaatttgtgccggatacccaattcctgacaggcgcgagcgaattcgcgtgaacggaacgccgaaccgttgtcggtcaactgccagcgcacacgcacgccgagtgctgcataccaagccacggcgtcacgcaagaactgcacggcactggcctgcttctcgtccggatgcatcgccgtgaaggcaatacgagcgtggtcatttacggccacaaacagatactcccagccgatgccatccaccgaattgcgccgatcgcccgtgacgcgatggctggggcgtgcgatgcggccgagcttcttggtatcgatgtgcagaaaatccccggagcctcatgctcgtatcgctggatcggctcgcgccgctgcagatcggtcaaacgagacaatccagcacgtaccaagactcgactgacagtcgacgcagatacaccgacctggcgtgcgatctgacgctgcaactagcgctgctggcgcaactcaacgatcagcagagccgtgtccggcgcaatcgcgcggggcgcacgagttggtcgagaagatgcgtcggccagtgcagccgcaccgcctgccaggtagcgtcccagccatttgcgtacagtcggcgccgtcacgccgcggtcggctgccgcctgcggcacactcaaaccgaattcggtgatatcgtgaaccatctcaagtcggcgggcaaacgtgagtcgggcattcttatgggtgttcatccggctggcttcccggaaggttggatgtttggcgacttccagtcgcccggactcagtccggatgaaccatcgatacaacccattgaagcttcacaactagagcgtcgactcggtgtgccgtttgcgcgagtgcgacacagtcgcgtgtttcgttttctccggcaccgctagctccaccggcgcccgccaacatgcaagcagtgcagtacacctatcgatgacatattgcgcggcggcggtgccgtgcaatgaatgatcgacggattcctgcagatcgaccgatatgttcggcaaatgagcgaacgctcgcgacgcgggaccgaaatgccgtaccagtgtatcgacgcccggatcgagcatgccgtagacaagatgggtgcgaatgccacgcgccgacatgtcgcgcagcaatcctcgcggcgtatccttgccggggtatctcccgacccgctctgcgatacgcatgatcggcaccgacatgaaatcgacgaggaagcgcgacaatccgcgcagtaccggacgcaaatcacgaccactgcgcagcagacggcgccactttccagcgctgcgcagcgacgctagatagcctcgcatcgaattcgtctgattcttgatcacattcgtgagcgtctctccgcgcggccacacgaagacctggagattgactgcgatcgcgccggcaaactggccgttcgacgcggcatgaagcgacgtatacgcaccggagcaaatcccgaacgaaacaaccttgtaatgcccgtgctctttcagccagtctgcagctgaaaccatatcggtgattacctgatccgaatacgggatgtcctgctgattgtcacgtgcgcgcgcgccactgtcaccgattccgctggcatcaatccgcagactgcagataccctgcgcggcaagcgaccgggcgagtcgaaccgcgaggcgtccatccgcgatgcgtggattggcggccgtattcgttatcaggagagtgggtgcggcggcacgcatgatgccttcggccggctcgcacagcaccccgaccatctgctgcggacccacgcgaacgattcgttcgatactttcttttcccttcagtaccacgccggcgtcggtgcattgcgcgcacgcgcgaacgatcggatccggatcgtcgtcgagccagtccgcaaccgtgtcgagcaatgcgtccggaagccgcgaccagagcggctctcgcattgcgtccgcccagtcggtgcatgcatgaacctttacctcgacaccccgcgcctgcaacgcgtccgaaagcgtcgcgctgtcgccgtacggtgcatcgaccagcaatgcgcgcgccggcaatgtgcccaattgaccggcaatctggcgcaggtcgatacgccgcagcgcctcgaccagatcatctgggtacaggtgtccgagtatgttcaggggtttctcgtcgcgaaccgcgcatctcacggtcggcggggcattgtcgagccagtgttgcgcgacgacagagagctcgcgcaggtagccgcgaccgcgcacgacgggcgcgagcgcgatgaaacgggttagcccggggatgccgtccgcggcgaggagcgccactgccgcgccggcacgtaccccgacgagcgtcagatggtccaccgtgatgcgctctcgcaatgcctggaccgcggactgaacgctcccgagcattttcccgaagcgatcaggatcgctttcgtcgcctagcgaatcgccactcgccggataatgaaagcgcagcaccgggaagccacggtcagaaagatgctcggcgagtgaacgcacgagcttgtgaagccaaagtgcttcgtgaccgagcggctcgcagatgacgatgccgtgtgttcgattgccctcgtgaagccagccgacgcatccatcaaactggacaggtgtcatggtcttatccttgttttaataaactctaacgaaatcctctatatggacttcaatcgtgcggtgccgaccgatatccgtttcatgccgcaatccagcatccccggaagatatcgggcgtccgcttctcgatcccgagaaccatccgcgtttctctttttcaatcggcccgaatgtcacccggaccgatccgtacggatcagccgtcagcgtcgccagaggcaaacagactactgctgcgccgcgcggtgagcgtacgcgcaaactccacgaacggagcctcgcacaaacgatagccggcccatgacaatggaatcaaaggcaggaccggtacgatcatgtagagaccaagcggccatccggtgacgtggaaacgctggcacaaccagaacattgcaaacaacgggaggctatgcagcaaatagatcgagtaactgatctcgcccagccatgaaagcaggcgaatgcggagcttcagaacagtcgccaatgcgacgaatatcgcgatgccgatgaagtaagcaagcgaagtcggaaagtgttccatgttgttatgtcgccaatcgctgagcgcccccatcagcgcgacacttgcaatcaccgccgtcaggcaacctaccgccgaccggtaagtgagcgccattcgacccggtgcaccatgccctggccatcgaacgcgcagcaatttgagaggcgtgtcgtatgcctgccgaaagcaggcaccccaaaacatgataccgagatggtacggcatggtcttgtattcgctgggcataccggccggggcgagtttcaactcgacgatcgtcacgaacagcccggtcaatccgatgctgacaacacataggcagaacatccggtgaagtacgccgccccagaacaagattaggcagagtccgtaaaaatacaattccgtctcgagcgtccagccatgcggcaagatcaggctttctccgaatgcggcgggcatcatggtcacgtttgccacgatcccatcgatatccatttttatcaaacagataccaatgaacaaaatatcccaaaggaagcgccaaccagtatgccgggtataaccggaagaaccttcgaacgaggaaccgcttcgttcccgcaccaatctctccgtgcaggctggagggaatcagcatgccgctgatcgcgaaaaacacgaccacacccacacgcccgaaattcatggagcgttgaagcgtgtcgagcatgtattgcgatcctgccagcggagcaaatcgctcggcatagtgtgtccatatgacgagtatcacggcaagcgcgcgcatcgcatcgacatggtgaaagcgcttcgaatcgttcgagtgggacatggctgaaatagtgaaaacccaagtatctcgatcgcaacgcgacacccatgcctgcggcgtccgcccaaatgattccggtcgtcgagatcgcaccgttcggtgcaacggcccaagcgaatgccgcattcaactcgagccggaacgcctcctgtcgatcacgtaccaccaaaccagtgcggccaacgcataaaatgccgtgcgcgagccgaacatcatccagtaatcgccctgctgaacggcgaaggtcgcatacgagaagaccttcgccatcagccacagcatcacgaccccgccacgcatcgtgaccaggatctgtaacgcggccagcgcaccatatacgacgccggtcatcgcgacgaaaattgcccccgacatagccgaaccaatacacgggtaccgccatgtttcccatcgtgaacgtgacgtcgtcgaagatgtaggccttgaggagttgtggctccatatacgagatcatcaagtcgcgcaaaccactcggttcggaatcgtcgaaaaaggttggcatcgtccaggaagcgagagagttcacgaaacgccaaagcagccgcgccgccgagtgccggtgccgtgaacatccgcgcatcaccgtccaccacgtaccacggctgccccagcagaaagcgcgacgagatcacatccgcaacttccagcccctgcccccggtaggcgtaaacgatggaaacggtgccgagcaagagcgccagcccggcacctatacccagatagcggacaaccggcttaccgttcatcgcatgaatcgcgatgaacggcgccagcgaacacaggccgatatgcagcaccgccatgaattgctcgccatgcagcacattgaggcccaggtcgatcgccatcgtaaggatcgccaaccaccggatgcgtttattggaactggtggcaatggtgcccaacaaaaacccatgaaggtttgattgttcaggaaaagattgaacatcgcgccgttcgacgcatcattgcgcaacgcatacctattgatgccggtaaacaacgagaatcccgacgtcagccccgccagcacaccggtcacgatgatcgcggccgcaagtgcaaaccccatcgtcatactgattggttgcaacgcaatccgcgccctgatcggcttgtacgacgggcgctcatcaaggaacctgtcgaatgcgacgagcgcacataagacaaaaatcagatagaacgaaagaagccggctgaaagcgccggtcgcctcacccgagatgtcggtttccctcaggtatccaccgttctccagtccgacaccggcaaggaatgcagtcagcccgatcgcgagtacatagagcaccgacactgcaaacaccggacgatacttgaccaggacgacaagtcccgatgttgccagcaacaacgtgcacgtggcgctcgactccgtcacgccgagcgccggcatcatcgcattgatcaaaaacgcaagcgcgaataacgtcgatatcgtcaccccggttgcggatatcggcccccgttgatttgtattgttcgcgcagttttgtctatcatgctgcaacctgaaattcgttccaccggtgacgcaccgttctagccgcgcgcgccctgcccgctgcaagatcgcccccttccgcaagcgcactgccggctccctcgctcgatccagccatgaaccagcgaattgactggtgcatgcgatatcaggcaacgtttctcagcagtccctttcttacccgctcccacgccctgaacagaaatgcaacgggtacgacgtcgcctggagcgtttcgcgacttggcttctttcgtatgcggctcgatgttcgcgtaatggcgccgacgcaacggtgaaggctgaaagccgttgaataccagcccatccactttcacgccaacccggttcaaattccggatcacatccgccacgccggcgtagctgaccgaaccttgccgcgccaccatcagcgtaacgtccgccagcctcgacaacatcgcgaccttcgcgaccgggcgcgccactggcgcatccacgacgaccgcgtcgtattcgcgtcgcaatgcggtgatcagaggatcgagccgttccatttcgaacaggtgccgcgacggctcgacacgttttcctgcaggcagtacatcgaaattttcccggacgtggtagatcgccttcccgaggtcccgcgagccagtcaacacatccgacatccctgccgggtatttcgtggacacgtatcgatcagcgcccgattcgtctgcatcggcacgcaccagcagtgttttgagaccgctttgcgagaacaaatgcgcaagattggctgagatcatcgacctgccctgacccggctcgggagacgtgaccagaacgatccttgatttaccctgcgtagcagtcgtcgcgtaacgcaacaacagcgccagatcgtccaacgcttcggccagcggcgtatcgggatactcccttgccgctataaacgccgatctgtcgttcaggtcggcctcgacctgatgtaacgaggtcgggacaatacccagcacagggacgccggccacctcctctaaatgctccggattccgggcgttttggaaaaacaacgcacaaccttgtgccgaagcaacgcccagtatcaaaccgatcgcagcacccagcacgatgacgagcaagcgtttcggctgaaccggtttgtcggtgacatcagccttgtcgataacggacgcgttaccgacggtgccagctttgcaatttgcagctgctgcgcgttgttcatcaagccgatatagagttgattgttgacctcgacgtcgcgcgataggcgcaagtaggtctgctgctgcgacggcaagcgcgcgaccttgcttttcaattccgccgactgctgatccagcgttttcagcttgctggctaccgcagtaagctgaggttgtccggcgacatatttcgacgccagatcctggtactcgagcttggcttcgagccgcgacttttctacgagcgccaactggtcgatcagcagttgcacatcgccttgcgcatcgatcgatccctgtgcattgcgaaactcgttcaacgcatgctcagcctgctccagtcgcttcttgaccaccggcaattgcgtgtcgagaaacgcaagactgtgctcggcatcctccgagcgccgctttgtcttggcgtccagataggcggcagcaatggcattgagcaaccgcgcggcatacacggggtcagggtcctcgaaactcagctgcatgatgcccgactgacgtttcgtttcggccccgttcagtttcttcaggacagcctcgagtcgcaccggcgtggcgacgcggcgcacgcgaaattccgtaccggcgcgtgccacgatccgcgatacctccacccgatacccgtttgcctcggttggttggcccacttggcccgccaacacctcttgaccattgctgttcttcaacaggaagcgattaccctcgagatagtcgagttccagtttcttgccgatctgcgcatcgggaacgtcgaatttcgtgaattcgatccgctcgccgccccacgcccaaaacggcgtatttaacaatggctcgacgaggccattgcgatccttcgacaagatcgaaccgagtaaaccgccgacgagcggaatcgtattcctgaccgacacatctacctgcgcgacggtagcgtcgattgcctgggtgacaaccgcgcgcgagcgagcgatatcgatctcgccgacgacggccgagttctggatatccagcgcgtttgaaatttcggagagcgaacccagcgcgctgtgcttgttttcctcgacctgtatcaacgtgtccacggagtacatcggtgttgccgcaacggcatacacgatcgccaacagcaaacaccccaggaaaacagccaggaaaacgcgccagtgatcaaacacgttttccagcagctggaccagcgtgaagtcaaccccgtttcgagaaatacttcccgatccgtctcgagatcgcttcgatgaaggcctatccaatgtcatgcatacgctcccaaattgccgtcctgacgggctcactgtcgccgtgcatgctgttgatcacgcatgtcccgccactcgctccgggccactcttttcggcacatcacgcgaggcacttgtcctgagtccgaccacctgcacgcgagaacgcaccgtcgaattcgttgaacagaaaacaagtgaccttgctggtccggatcactatgcgataaatgcgcggttttctgagtgcgatgccttacattaagcggccccgagtaagcgaatcaccgggtcgccgaccctctcgcgccacgtcgggggcgattcgagaaatgtggcccagcctacttgaacgcgcccgaccgcaatgccccctgttttcgacctaccccaaccgcacaaataaatgacgaatcaacgactgctcgcgagcgaccaatccggcctgctatccacggctgggtgaactaacgcacatcctttttccgtggttcgtccaacatggcccatgcgggaacccatcccggatcggccggtacgcccggcagcatgcgatgaggtcgaggcgtttgatagtcggtcgactggaacggcaagcgagcgaggaaacaagtggggtcttcggtcgaactcaggttcatgagccccgtcacctgccgaaaaacgtcttcgtcgcaatacgtcaatgtatcgatgacaaggcttttgtttaaccatgctgaatgacgacatgagcagccacgaacgattcggcacatcggtgccgaacaagaacgacccgacagggcgccgaacgcgcgcggcgctttgcctggcgatttccgccatgctttccgcttgtgcatatgcgcccggacagcacatggcgtcgtcccctgcattgccggtcacgactgacgacaacggtgacgtgaccagcgacatgaaggtgccggtcaagcagatcgatctgacgctgatcacgctcattcgcgcagagcagaagaaccgcaccgcgtcgcccattcccgacaatctgctcggcaggccaagcggctacaggctcggtccgggagacgtgttgcaaatcacggtatgggatcacccggaattcgccaccgctgccggccagccgacgccgaacacgaagtcctcggacgcggcgcccggtttcgtcatcgatagcgacggcaacgtgcagtttccatacatgacgcgaccgatccacgccgccggaaaaacgcggtgcagatccagcgggaagtcactgccgaactcaagaaggtgtttatcaagccgcaagttaccgtgcgcgtggcatcgttccgtgccgagcaggtgtatgtagacggtgaagtgcgagcacccggttcgcaggcgatcaacgacattccgatgaccttggtcgaagcagtcaatcgcgccggtggctttgcaccgacagcggaccagagtcgcgtcacgatcacgcgcaatgggacgacgtatccggtgaatgtcgcgcggatgatgcaaacgggcaagaaccccgccgccatcatgctgcagccgggcgacctgctgcatgtgagcgcgcgcgaagacaatccgatctacgtgatgggtgaagtcaacaagccgctggccgtgccgccgcaacgtgacggttcgctcacgctgaacgaagcacttgcacaggccggccaactcaaccagcagacgtcgaatgccaaacaggttttcgtgttgcgcaaggccgacgacagcgatcccgtagtctatcgactcgacatgaagtcaccggtttcgatgctgctggcgaatcagttcccgctggcgtcgaaggacatcgtctatgtcgacaataccgggctcgtccgggccagccgcgtgctgaatctattgctgccggcaatcagtgcgggtttgaccggcgcgctcatcaccaagtaattccgcttgtcggcctcggcaagccagcgtgcgaaccggaaagacaccgtccggtgacgcacgctgtttcatttatccgggggatacgccgcggcctcgcgtgagcggcacgatatacagtcggctagcgccccgcgctacctgccgtcacggtcgtgctccggcgcggccgctcccgcggcgacacacgattggacaccgtccagcccggcgcgtatgtgagcaaccccaccgaacgccaaacttcatacggaaatggtgccacaccctgaaaagcgatcgtgaccgcggcttgctaaccgccacaccacttgttcagtgttgcgtcgaacgtaaaagtcaggacctggccgttcgccatgacgacattgccgccggttgtcgtctggatgttcgcgttgttcgcgatcgtgcaattgccgttggtcgcaacgatcttcaccgactggccgtcgatgcccccgatcaggttggtcagcgtcgtgggcgacgcgtagttcgccgtcagtttgctgataccggtcaccccgggcgtcgaacttgtgccgacgaagccgttggaccataccgccatcgcgttacccgcgctgtcggccgtcggcacgccgtagctgtaacgaacgagcccggttgcattctcgatgtgaaattgccacggccacatttgcagcaggcgcccgctggcccatgcgctgttgacagcgcgtccgtagcggtcttccggaatatatttgtagcgcccggcgacaccgttgccttgcgaagcgtcgacgcagatcttcgagaagtattcaccggcaggaatgtacgcggtactggatgaagacggcgtaaacgtataggtgtcggtcccggccgtgacgcttcccgaacgcgtgatcgtgcccgtgatgccgaaaatggtcgccagcgtcgtatcgccggtcccgttgactgcgttgaccggcatgaagatcgacaggttcggtgtcgtaccgaacgaccagcccgggatcgcgacggcgcccgtccccgtcagcatcagggcggatgcgacctgctgaaacacactgtcggtctcgcaatcgattcgcaggttgtacgggctctcggtggaaatgaacaccgcctcggcacatccgaaataattcctgaacctgatcgtgttgtagccgatattcccgatcgtcaccccttcaccgtcttcgggaatgcgaaggtaaattcattgtccgtgggataaacattgaaattcgggttcggcagaatctccgctgcgtaatcattacgtgcgctcagcgggacgttgatgtcgaaaaggcagtttgtgacctgtccgatgacgctaaacatccggccgccgctcagtcccatcgtcgtcatccggtcgtgcagcacgatgtttctcgcttgaattccgtacagcgggaagccggtattcgacgtgcgccgatcctgcacggcaagcgcggtgccatagctgaagatgatgtcgatattgttcaggttgaacaggttcgacgagtcggacatagtggcagccgggctgtcgtcaaggtagaccccgaaactcggcgtattcgtcgacaggtcgccgcagtgcctgatcttcatcgtgttcagattgatctcgcgcacgttggcgcgtgcttgcgtcgatccgcttccggtgtccatccacagcacgccggcgccgcggaaatacagacagttcacgtgagcgacatcgagccagtccacgttgccctgcaacaccaggccatgttgcagtgatgcgcacgcgcgattgccctgaagggtaaagtcgcgcaggacacacccggcgagcacggccatgttcgacgtccatgacacgtttccggtctgcggcaaatccgtcgcttcgttgttgaagcccgcgttcaataccgtcaggcattggccgctgacgccggctccgaactgaatgatcgaggtgcgcgccgaatgcccgaacacggctatcggcttggtgatcggcggaagcacgaggctcgaatagtagaccccggcaggcaggtcgcctttgaccggccagatagtcatcaggtaattcagccaggctgtcagggccgggccgtcgtcggtgccgtagaccacgttcgccccggtcgccgacgcattggccgctttcgcgagcgtgatctgcgttgcgctgacgaacgccgcaatcgtggtggaaacgaccagcgttgcaacgccactggcgttcgttgtcgcgatgtcgatacgcttgccgacgtccgccgccgtgaataccgccgaggccgacgaaaacgatgttgatcccgatgtcgtgacgccgtcgttgacgatccgggtgtttccctttgcaccaaaatatttggcgctaaccggcaaattggccggaagcgccgcaggtaaatccatccatacctgtgtggtacccgcagccagattcacgaccgcaccgccattgctcgacgccagcacggtggtacgcgctagcgtgttcccgctggcgttgtatgtgccgattccgatctcccagttcccgctcggaacgccggcccccgtgacggcttgcagcccgtaatagaaagtatcggcattggcgcacacggacgaaaatgcgcggaatcccgtcattgcaccggccagggacagtgcccccgtaccggtagaagtggtcgtttcctgaacccgatcctgaagctggaatgccatatcgatcctgcacgtgtgattgtcggacttagcggaaatcaactcctgccgcaccttcggattcgatgcccggtatattgattaccgaaaagagatgtgcgagttcgatcgagcgtacgcacccgcgcaagactataaacagattcaccggcaaacagtgcgtgaaatgacccaagtgattgagcgataccgccatcgccatatgaaaagtacgtttcgaacatccggtcaaccgcgtcgtattcgatgacatgtcaatgtcgatcccgttagatgtgcacgcaacgaaccggacaactagtctcgcaatagcaccagcacacaggtacttcttacccgaccacacccccaccatcgggaacgatgaccgcctttccaacccaccctgcgcgactacgcgataaagatcgtacgtatcggtagaaacaccgatgctgtagtcaaactacattcataccattagtcgctgcagagaatcgctacatccgattcggcagtgccgggcggcctgcgcgtcgccgcccgcgttgaccggtcgagcccaaccggccgtaacgattccccgcccggcctggcatgccgacgcgcaaccaccctgcatcgccagccgaatgcgtccggtgcgaatccaccggacgagcgcagctccagacatcatccgaacaatcggcaatacgatcaggagagcaacatgcgggacacactctggccggccgtcgtgctggcagcgaccctctgcaccaccgcctacgcaggcgacgccgacttcaacgcacaaggcgatgcgaccgatgcgttcgcgtcggccgccgcgcaacggcgcgccgacctgctcgtgcgcaagatgacactcgacgagaaactccagttcatccattcgcaatacgaaatgtccaaggtgccgggcggcggcgccggctatatccagggcgtgccgcggctcggcattcccgatctcaacatggtcgactcggcgaccggctccggcagcacgtcgcaggccagcacgacgttccccgcgacgatcgccgtcgccgcgagctgggatcgccggctgtcgtacgactacggcaagcaggtcgcgatccagttgcgcgcgcaaggattcggcatgggcctcggcggcggcaccaatctcgcgcgcgagccgcgcggcggccggctgttcgagtatctcggcgaagatccgttgctcgcgggcgacctgctcgccgaacgcacgctcgccacgcagcggcaaaaggtcatcgccacgatcaagcactacgcgggcaacgagcaggagcacggccggatgggcggcaacacgcagatcgacgaacgcacgctgcgcgagctttacctgctgccgttcgagatcgccgcgaagcgcggtcgccccggcagcgtgatgtgcagctacaaccggctgaacggcgcatacgcgtgcgaaaaccctcacctgctgaacgacgtgctgaagaacgaatggggcttccagggccaggtgcagtccgactggggcgccacgcacagcacggccgccgcgatcaacgccgggctcgacgaggaagaagacgtcgggccgagcgtgtacctgacgccgacggccgtcaagcaggcgatcgcgaacggctcggtgtcgaccgcacgactcgacgacatggtgcggcgcaagctcgccgtgatgatccgcgtcggcgtgatggacgatccggccaccggcggcggcacgatcgatttcgcggccgcgaaccggttcgcgcaggccgcgtccgagcagtcgatcgtgctgctgaagaacgacggcaatcagttgccgctggcggcatcggcgctgtcgcgcattgccgtgatcggcggccatgcggacgcggccgtgctgtccggcggcggctcgggcaacacgcgcgatccggtgtcggggtcgttcgcgggttgcggcggcctgacgttcggcgcgtcgaccgggtgcagctggtggcgcaatccgtggctgaaggtcgacgtgccgatcgtcgcggccatccgcgcgcttgcgccggccgcgcaggtcacgtatgcgggtaacagcgaccagcagtcgccgttccgtgcgtacgcagcaggaaatcgaccaggccgcggcgctcgcgggccgctcggacgtcgcgatcgtcgtggtggcccagccggccggcgaggatttcggcgacctgcagagcctgagcctcgcgaacccgtcgaaccaggacgcgctcgtcgaagccgtcgcgcgcgcgaatccgcatacgatcgtcgtcgtccagagcggcaatccggtgctgatgccgtggaaggacaacgtgtcggcgatcgtcgaggcatggtatccgggtgaagccggcggcaaggcgatcgcgaacgtgctgttcggcgcggtcaatccgtccggcaaactgcccgtcaccttccccgcgcgcgatcaggattcgccggcctggggcaaaacggcacgttcgacaacgacccggtctacgcggaaaagctgaacatgggctatcgctggtatgacgcgcgcaacatcaagccgatgttcgagttcggctacgggctgtcgtacacgcacttcgcgtattcggggctgtcggtgtcgaagcagtgggacgggtcgctgagcgtcgcgttcacggtacgcaacgacgggcgcgtcgccggtgcggagatcccgcaggtctatctcggcgtgccgtacaaggacgaaccgccgaagcggctggtcggctgggagaagatccggctgaatccgggcgaggcgcggcgtgtccgcgtgaccgtgtcgccgcgcatgcagagcgtgtgggatacgtcgcgtaacggctggcggttcgtgccgggcggaaccgtgtacgtcggtgcgtcgtcgcgggatatccggttgcaggggcactgagcggcacccacccagcggaagagccgcgcgtgtcgtgcccggctcttccgtcttccgccatccacaccggcgatcctcaccggaacagtagcgccagtagcgtcgcgagcgcggcaatcgcggcgatccccgccgcgatcccggccagatgcgcggcgaccacgaggccggccggcaatcgcacggacgccgggccgctcgccccacccgacggcccggcccgcgatcgcgacgcgacgcccgtcgtcatgctccgctcccttccagcgtatcgagcaacggcctcgccagatgcagcacctgatacaccgtgcctgcgccgccgccgtccggctcgtgttcggtgacgagggcacgcgtcagccgccagcgtagcgagtccagactgaccgcggccgccaccacaccctgccgcgccgccacttcgcgattgcgcgtcacctcccgcgccagcgtcgcctcgaggtcggcatccgccggaatatcgacggcttccagacgaacgaagcgccccgtcgacgcactgcccttgcgcgcatcgagcgcgacctgcacgtcgatcggcgcgcggccgaagctgtccgtcacgacccggtagcggccgcccgtgacgaacccggcgaacgcctgctcgttacgccacagatagaacgacgcatagccgttttccgtcgcaccgtagcggcccgcctcgcgcagcaggaaccccttgaacaccaggtccggcgtgtcgtcccagagcctgccgcgctcgcgcacgcgatggcggatgatgtcgaggtcgtagtccgccggcaggcggtgcacgtagtacgcggtcagcatgatcgactcctgaagggaaacggagattccgagtggctcgagaacagcgtagaagaccttgaatcatttgaaaatacgatggcagaatatttcaatgattcgatttatcaatggatgagagtgcgatgaaaacgctcgacatcgaagccgtgcaggcgttcgtgctgaccgccgacctcaagagcttcacgcgggccgccgaggcgatggacacgacgcagtccgcggtgagcctgaagatcaagcggctcgaaagcggcctcggccgccgcctgctggaacgcacgccccggcaggttcgcctgtcggccgacggcaccgcattcctggaaccggcgcgcgaactggtggccgcccaccacggtgcgatcggcgcgttcggcaccggccggcggcgcctggtgatcggcgtcagccaccatgtcgtcggcgccgatctcccgatgctgctgcggcgcatgagcgaagcggagccgacgctcgtgctggagatccgcgtcgccgcgtcgcgcgacgtgctcgatgcattcgaccgcggccagctcgacgcggccgtcgcgctgcagcacgacagccggcggctcgacggcgaaaccatcctgtcggagtcgttcggctggatggccgcggcggatttcgagtaccatccgccgcaaccgctgcggctggccacgcaagccgaaccctgcagcgtgcgccgcatggcgatcggcgcactcgaccaggccggggtcggctggacggaggtgttcgtcggcggcggcgtcgcgacgatcggcgcggcggtgtccgcggggctggccgtcgcggcgctcgggcatcgcgtggcgcccgccggcacggtcgacgtcggtgcgcggtacgggctgccgccgttgccgacgcgcgacgtggtgctccactcgagcctgaccgatgcgcgagcccggcaggcgctgcgcacgctgggcgcgacactgcgcgcgtcggtcggggcgcgttgatgccgcacgagccggtgcaggccgtatcgtcccggctcggcccatgccgaaccgaaccacccggagaagacacatgcgtccgctggacgaactggtcaacgagcgtgaatccgccctgccgtcattgatcgagtggtcggcggcagcgcgtgatcgttgcgagatattgccgccatcgggccggaatggcgaaatcctgtcaacccttcaggtcaccacgcgatcgctcctggggaccatcgcctattcgaccggcggcctgctcgtggacggcggctatcttcgtctgctcggctcgggccatcccgcgttgccccgggacatcgtcggctggaatcaggaacgctcctccggctttctgttggtcgcggatgacgccgtcggcggattcttcgccttgaacggcggcgcactcggggaggacacgggctccgtgtactactttgcacccgacacgctggaatgggagcccctcgggatcgggtacggcgacttcgtgcgatggtcgctcggcaacacgctgagcgacttctacgcgaccatgcgctggcccggctggcaggccgacgtccagcgcctgacgacggatcaatgcttcagcttccatccattcctgtggacgaaagaaggatcggtcgaacgcagcagccgtcaggcggtcgacgttgccgagctgtatgcactccagatcggcgccggagccacgacgtcaaggcaaccgtgatccggcgtacctgccttcgaatccggaacgccgagtcccgtggcaaagccggtgcgcttgcccgcgcctgagcattcgcatcggcgtcgcgttttgacggcttcggaaggcatcgatgcgcgccacggtaaaattcacggttcatcccgcccgctcgtgccgccgcccgatgcctgcgcgggtcgatatcaaacgcatcgccaggccgtcatcatcttgatttccctacacctttcatctcgcgacgcatgagttactcgctcgccaccacctgcatccgcgaactcgagatccgcaagagccgcttcatcgggctcgcgatccccgtcgacgatcgcgacgccgcgatgcacgcgctgcagcgcctgcgcgacgagcatcctgcggccacccacgtatgctgggcgttgctggcgggtgggcagtcgggcatgtcggatgacggcgagccgtcgggcaccgcgggccggccgatcctcgaagtgctgcgccatcacgatctcgacggcgtgctcggcgcggtcgtgcgctactacggcggcgtgaagctcggcgcgggcgggctggtgcgggcctatacggatgcgatcgcatcggcgctgctcgacgccgagcgcgtcgaacgtgtccgctacacgcggctcgcgatcgagatcggctacccggacgaggcacgcgtgcgccgctggatcgaacaggccggatacgcgctcgtggacagcgcatacgggatgacggtgaagctctcgatcaagctgccggaaaacgccgaagccgcggcaagaaccgagctgttcgacctgacgcaagggcgctcgggatttccggcgacgtgacgcgcggggaacgcgtccgcgttcccgcgtggccggacgaatcccgtcgccggtcagtcggtcattcagtaggtatcggggacgatcatgtggtccggcaccggccggcggatgtagtcctcgtgatgctcgcgcggcggcaggtcgatcggtgcgtgcggcacctcgtgatacggcacctgctgcagcagatggtgaatgcagttcagccgcgcgcgcttcttgtcgaccgcctgcacgacccaccacggtgcttccggaatgtgcgtgcgaagcagcatctcttccttcgcggccgtgtaggcttcccagcggcggcggctctcgagatccatcgggctcagcttccattgcttgagcggatcctcgatccggctctggaatcgcacttcctgctcgtggtcggtgatcgagaaccagtacttgacgatctggatcccgctgcgcacgagcatcttctcgaactcgggcaccgaacggaaaaactcctcgtattcgtcgtcggtacagaagttcatcacgcgctcgacacccgcgcggttgtaccagctgcggtcgaacagcacgatttcgccgccggccggcagatgcgcgacatagcgctggaaataccactgcgtgcgttcgcggttgttcggcgccggcagcgccgccacgcggcatacgcgcgggttcagccgctgcgtgatgcgcttgatcgcgccgcccttgcccgccgcgtcgcgccctcgaaaatgacgacgagccggtgccccgtgctcacgacccagtcctgcagcttcacgagttcgccctgcaggcggaacagctcgcggaaatactgcttgcgcgcttcgcgccgctcctgcgaaaacagcaggtcgtcgctgtcgtcgaagcggcgatcgtcgagctccatctcgagttcttcgtcgtaggcgtcgaccaggtcttcctcgaagcggcgctggcgcgcttccatcgattcgagatcggtgcggttgtcggtctcggtgcggttatcgttgtcgcccatggggcctccttccatcgttgacgcagccaaacgccgacattatcccagcgtcgcgcgtcaaattcatgaaaaaggccggcgcaccggtcagaagcggaacgcgagcagcacgctcgccagcacggggttcgcggcaatatcgaacgtgttcgacgcgagctgccggttcggctggtcgatatccagcgtaatcttcgtacgtaacgggatataggtcaccatgccggtgatccagaactggcgcgtgatctggtagctcgcaccgaccgtgaacaccggctcccacacgctcttcaccttcgccgacacgttggtcttgcccgacagcagcaggtcgccgccggcatcccagatccgctggaacagcgccgggtcgagcagcagcgactgcaggctgccgatgtccgcgcccgccgcgagcagcccgccgagcgacgcgagcttgcgctggaacacgggattcaggttcgtgttcgtgaagcgcgtatagctgacgccgatgcccgcgaacgggcggaaacggtcgtcgcgctcgccgaggtaatacttgaacacgacggacccgagccacgcgcgcgtggtcgcgagcgggttgctttgcgtgttcgcgagatcgatcagcggaaagcgccctggacgcctgaaaagatccggtcgagcggcagtgcgatgctgccgtgcccgcgcagcgtcagcaccggcggaatgcccgcgccgagttcggccgcccagttctccgagaaaaatgcgtcagcgtgaacgccagcgtgttcgtgttgccgagcgacagctgcgacccctggttctcgaagctgttcagcccgagtgcgtccgtgtgcgtcgtcacgggcgtcgatcggccggtcgtgccgacgaagtgccagccgaggccgaccatgttgcggtcgtcgcccatcagctgcgtcagcaacggcggcgcctgggcggccggcagatcgggcagccgcgacggatcgaccggatgcagttcgtacggcatccggtcggcatggacgacgccgggcgccggcatgtcgctcgccgccgcgtcgcgcggcgcggccggatcgcagccgccaacggcgccgccgtcgtcgaagccgatgccgtccgcgccgtcgccgggcgctgccgcgcatgcgcgccccgccccgccggttcgctggccgagcgtgatcttgcgcgccgtcaacgggacggcgtcgggttgcggcccgtcgacctcttctccgtgcctgccgagcctgccgtgcccgtcgcgcgacggccccgcgtcggtcgtccatgcgctcgcatcgaatccgtccgcgtcgccgcccggccagaagccgatcccgtcggcgccggcctgccagcgtggttcggcgtccgcgtccggctgcggcgcgccatgcgcggcggccgcgcacgcgaacagcgtcgcgccgagccagcgcgacagcggacgcacggcgcccggccgcgcacggcggcggtacgtgtcccggctcgccatcggctcaggccggcacgccgaacaggcgttgacggatgcggtacaacggctcgaacagccattcgagcaggctgcgccgctccagcacgatgtcggccttcagcatcatcccggcccgcagcgacagcggccgcccttcgaacgccggcgtgcggtcggccagctcgacccaggtcttgaagtaggtctgcggcgtggcggcatcgcccggcaggttcagctccttcgcggaaaacgcgacgggcgagatcgacagcaccttgccgcgatacgtgccgaacttctcgactggatagcttgcgtacgcaaccttcacctcctgccccttcttcacgaagccggccttcgacgacggaatgtagacctcggcgatcagcccgtccgccttcgcgggcaggatctcgacgacgcgcgtacccggcgggtcgatcacgccgccctgcacgacgtcgagccgcacgatctgcccgtcggccggcgcgtacagcacctggttcacgttctcgtcgatgttgtattccttcgcgttcagctcctcctgcttgatcttcagttccgcgttcgcaccgtcgtacttgctctgcatcgtgtcgaggtcgccgcgcagcttcatcgcattcttcgcgagctcggcgcggcgcagcagcaggtcctgatacgcctgcccggcctgcaggtactgcgtgttgacctggttgtactgctcgagcgtcacgacctgttcgtcgagcagctgcttcacgcgtgcgcgccgttcgccgtactcgtcgacgatgcgcttctggtcctggatctgccggtcgatcagcccgcggctctcgccctgcgcggcgatctgctggttgatctgctgtaccgacgaccggtattcgaggcgtgccgcgtcgatctgctgcgtgacctcgacgcgctgccggtcgagcgccgcacgcatcccctgcacgttgttcgcctggctcacgaagctcgtgtcgcgcgtcaccgccagcagccgctggccggccttcacgtgctggtccttgccgacgtagacgtcgcgcacggcccagcccggcggcgcgctgacaccgatcagccccgagcgcggcgtcagcatccccgatacgctctcggtgttcgcgtagctcagttcgacaagcgcggtcacgaacatcgcgaacatcgcgagcgacaggtagcagaagaagcgcatcgacaccggcacgtcgacgacaccgtggatcacggtgccgaaggtcgtgccgcgcgcgagcttgcgcgacggcttgtgttctcggagggcggagttccaggtcggcatggggcaggctcgtcaggagcgacgccgcgcggccgcatcgagcagcggcgtcggcatcaggtaaggcgtgaagtgttcccagaaatgccactgctcgggctgccgcacgagcgcctgttcgagacggtcgacgatgcgctggtgcgtggcgcgcaccggcgacgcgtcgtcgtccgcgccgagcatcggcgcgagcgggctggccgccagctcggtgaaatgcaccgcgcagcgatcgcggaacggcacgcccgtcgcatacgcgacgagcagcggaatccctgctcgaccgcgagcttcacgccgccgccggccatccgcacccagcggccgccgagccggcagcggttggtcttgccgaacttgccgtgcaggtcggagaacagcaggaacacgggcgcctcgcgccgcaggctcgtgatcagccgccgcaggtgcacgcgctcctcgatgtcgatgaactcgacttcgccagcgccgtattcggcgacgagccgcagcgcatcgtcgaagaacgcaccgggcgcatcccggtgcaggatcaccatcagcttgcggtcgtcggggatcatgaagcgcagcttcgtgacgaacagcatcaggttgccgaagtgcagccccgcgagcatcagcgggccgccgcgcgcgagtgccgcccgcagctgctcgtcgccttcgcacgccatcccgtcgatcatcgacttcatcgattcgaggctgtgcgtgcgcagcttgagccccgcgaattccgcttcgaacagttcgcgcacgatcgccgccgacacgtcccgcacgcgtcgcggatcgtcgttcaggtgcgcgctcagcatgtatgtgaccgcgcgctcgatcgactcgcgaatgcacggaaagcagcgcaggcaggcgcccgagcaccagcgcatcagccgcagcccgcgcgccggcgacgtgcgcagcgcgacggcccgcaccgcgcgccgcaccaggaatgcatacgagaaaggattgagcaggaagagtcgcccgagcatcaccgtgcctcctcggccgcgcgccacgcatcggtcgcgtcggtcaatacgccgtcgttcatctggtagatccggtcgaccatcgacaggatcgacgcgtcgtgcgtgacgagcacgatcgtgcacggcagcgtcagcacgttgcggcagatctcgtgggtcgtcgcctgatcgaggttcgacgagaattcgtcgaggatcagcaagcgcggctcgcaatacagcgcccgcgcgatcaggagccgctgcatctgcccggccgacaggaatttctgcgtatcgccgagcggcgtgtcgtagcgatggtcgagccgctcgatctcgtcgtgaatgcacgcgagcttcgccgcgtcgaacatcgcgccgatgcgcggcgcgggtgcgaagttcgtgatgttgtcgcggatcgtgccgcgaaacagctggtcggactgcgtgacggccgcgagatgcttgcggtactgccgcaggttcacttccgcgagatcgacgccgccgacgaacagcgtgccgggctccggccgcacaagcccgcagatcaggttcagcagcgtcgtcttgccgctgccggtgcggccgacgatcgcgatcttgctgccggccggcacgtcaagcgcgatgtcgcgcaggatcgggcggttgccgcccttcggcgtgtacgacagcgcgcggacggaaagcgtgccgtcgaaaccgtcgacgggccgcacgaccgcgtccggcgcgggttcctcggtctcggtctgcaacacgtcggcgacgcggtccatgtgcacctgcaacaccttgcggcgcacgtagagctggatcgaatcgatgaacttgtccgcgaacaggttcttgtactggatgaacgcgtagatcacgccgatcgtgctctgcccgtgcatgacgagccacgcgccgtatgtgacgatcacgagctgctcgacgtgcacgatccccttcgacaccgcatcgaacagcagttgcagccgctcctgctggcgcatcgcctgcagcttctgcgtgaatgcgttgacccacaggctgctgcgcgcggtttcggccgacagcagcttgatcgagtgcgcggagcggatgttctcgatcagcagcgcgtcggcttccgcgccgcgcgtgaggatctgcgacatcgcgtcctgcagctgcggctggatcgcgagccggctgagcgcgaacagcaccatcccggccaggctgatgccggccagcaccgggctgtagtacagcatcagcacgagcgtcagcgtgcaggtgacgatattgagcagcccgccgaccagtccgtcgacgagaaaccgcccgacctccgacaccgacgacacgcgcgagatcgaatcgccggtgttgtggaacaggaaatagccgatcggcagccgcgcgagatgcccgaccatgttcgccgacaactgctgcgacacgatgttgcgcaggtagctcttgatgttgccgacgaggttcgcgtagagcgtgtcgaacaggaacacgatcgcgaacaggatcgtcagcaggtacaggatgtcgacgtcggtcttcttcagcgcctcgtcgatcgtcagttgcacgtacgacgggccgagcagcagcaggagctgcgcggcgacgccgcccgcgatgccgatcgcgaggctcttgcggatgccggtcagcccttcgaggtagtcgcgcagccggatccggtcggcccgccccgcccgcgtgaagccgatatcgggattcagttcgagcgcgtagcccgtgatgtgcgtgagcgcctgcgcgagcggcagcttcgtttcgccgagcgcgggatcgacgatgtgcacgctgccgtagccgaccttcgtcaacacgacatagtggttcatccccagtgcaggatgcacggcgtcttgagcgcgtcgagttcgcccgcgtcgaactgcagcccgcgtgcgcgcaggccgagatcgttcgagatctccatcaggtcgaagaacgacagcccggaatcgatccgaccggatagcggttgcgcagcgtgcgcaacgtcgtttcgcgaccgtgccacgacgcgatcatcgcgaggcaggccaggccgcactccgtcacctcgtcctgcaggaccggacggactttacgcgtattgaagagcatggtcgggcacccgaggcgcgacgacacgccgcccgggcctgccgatgcgggcccgtggcgggtcgtgcgcgatacgcaagggcacagccggcacgctgccggctgcgacggaagaccggtgttaccggccgcctggcgggccgctcagcgcgacgagccgagcgacatccggaactgttcgacggcgcgggtctggtactgggtcatcaggccctgcagcgtggtcccgatcgactggttgacgagatcgaccgtataggcggccgaattggagtaaagcgacgcgccgccgcgaatctggcgggcctgttcttccgtgatgtctcgcatttgttgtggcctttatattgtcggaatgcccgccaccgtcagccaattgaaattttaatggccgttaactttattacggggataatccggcactcccgcctcctgataatcgcccgaaccggaaataatgcattccggattcgctttattgccacttcggcgatcgattcttttccttctgtttcgcagcatttcgcgcgggggcgcctcccgcgcacggcggttacttgccggtgttattgaacgtcttcgggttctgcaggtaattgccgaggctcggcaggaactggccgagcgcggtcaccaccggcgcggcgtcaacggcgaggctacccagcgagctgatcgcaccgccgccatgcacattcctgacctgttccgtcgtcatgaccttcatcattctctcctcgtaaaaataaagatgatgcaaagaaccttcattgaaagacaaacggcttttaatccctagcgacttgttaatctaataatcactgcgattacgagccgaaatcaggctatcatgcgggcgcatcggaattcaatggaggacacactcttacaggcgcgttttccggtgcgccacggatggcaggcattcattctgtttgaatttcaatttcaatacgtttaaatcccgccgcgatgcattgcggcacgggcaggagacggagacggccatgtttgaaacgaggcgcgcgaattacggatcggcgacgcggaattcgggtaattcctatcaagttttacgactaggtggaatccccgacttgcaaccgtgacattgttcgctgtaacgatagccggcctgtcggcgaacgcgcgcgcgttctgcctcgacaccgcctaccagtacgcggtcgtgcacgatccgcgctacctgcaggcgcgcagcgaatacgatgcggcccgccagaaattcccgaagcacgcgcgcagatgttgccgcaggccgccgcgcaactcgaatggggacgctacggtacgcacgcgaacctgttcggcatcgacgtcagcggctcgagcaatgccgcatacggttccgcgcaggtcacgcaggcgctgttcaacgtgccctacctgtacgacatgcggcgcgcgaccgagtacgaggaatcggcgaaacagaagctcgaggtcgcgaagcaggacctgatcctgcgcgtcgcgaacgcgtgcttcgacctgctgagcgcacgcgagaaactgcagtcggccgacgacgaagtgaacgcgctcacgcggctcgaaagcgatacgcgacgcatggcacagctcggcatgaagacgatcggcgacacggccgaaatcgaggcgcgccgcagtctcgcgcaatccgacgaagccctcgcgcaaaccgacgtggacgcgcgccgcgcgctacgagacgctgctcggttcgacgatcgatttctcgcgctggccgcggctcgcgatgcgcggctcgtcgccgcgcattccgtcgggcgaatacgcgccgcaggacaaccccgcgtaccggcaggcgtaccgcgacgtccaggtcgcgcggctcgccgcgaagcgcgtcagcgccgagcacttgccgaccgtcgacctgttcgcgtcgtattcgcgcgggctcaacccgaacctgcgcgggctcaccgatcgctccgacttccatcagagcgcggtcggcgtgcaggtgacgatcccgatcttctcgggcggcagcgtgtactaccggcaggtggaagccgagcacgtgaccgagcagtaccgcaaccggctgcgcgaagtcgaggagcaactgggcaccgatcatcgcgaggcgctgtccgcgctcgaatcggtcggcaagcgcatccgcgcgctgcagcagtcgctgcaggccgcgcgcctcgcgtacgattcgtcgatgaaggcgcatcaggtcggttacagcacgacgtacgaaacgctgaacctgcggcgcgacatctcgggcatccggcagaagctgttcgacagctatctcgatgcactgaagctgcagctgaagctgaaaagcgtgctcggcacgctcgacgagcagtcgttgatcgcggtggacagctttctcgaaagcaatgcggcgagcgagcgcggttaagcgcaattgagcgtgggtcggcgcgcatcggcatcgcgcaaaaaggttgtacacgcaaccttgatggccgatgccgacgcgccggccggccgatccatcgaagccggcgcggcacgacaatgcgccgtcgttcacgcaagcgtgcgtccgaccccgctcgatcgcgcggcgcaatacacgatcccgggcgcacgccgcgccctcaccgcgtgcagggtatacgcgatgttgcgtccaaaaaaactttgcctagagtgcatcccatcgatccggcggacaaagacgtcccacgatcgtgcgcagcgcgcgcccgctagcccgcgcttcgccggccccgtttcgggccgcccatccgcattcccgttatccgacagcgttgtcggatgaacggaccggcaagaagcccttgcctcgctcgtcgaggcaagggcttttttgtctttcgaaaacgcacgtcttcacccgaaccaggagcacaccatgcgtcatggcgatatttccagcagcaacgacgccgtcggcgtcgccgtcgtccagtacaagatgccgcgcctgcacacgcgcgccgacgtgatcgcgaacgcccgcgaaatcgcggagcgcgtggtcggcatcaagcgcggcctgcccggcatggacctcatcgtgtttcccgagtattcgacgcacgggatcatgtacgacgcgaaggagatgtatgacaccgcatcgacgatccccggcgaggaaaccgacatcttcgcggccgcgtgccgcaaggcgaacgtgtggggcgtgttctcgctgaccggcgagcgccacgaggaacacccggacaaggcgccgtacaacacgctcgtgctgatcaacaaccagggcgagatcgtgcagaagtaccgcaagatcatgccgtgggtgccggtcgaaggctggtatccgggcgactgcacgtacgtcgccgaagggccgaaggggctgaagatcagcctgatcatctgcgacgacggcaactacccggagatctggcgcgactgcgtgatgcgcggcgccgagctcgtcgtgcgctgccagggctacatgtacccggcgaaggaccagcaggtgctcgtgtcgaaagcgatggcgttcatgaacaactgctacgtggcagtcgcgaatgcgtccggattcgacggcgtgtactcgtatttcggccactcggcgatcgtcggcttcgacggccgcacgctcggcgaatgcggcgaggaagagaacggcgtgcagtacgcggagctgtcggtgagcctgatccgcgacgcgcgccgcaacatgcagtcgcagaaccacttgtacaagctgctgcaccgcggctacacgggcaagatcggctccggcgaatcgccgaacggcgtcgcgcaatgcccgttcgagttctatgcgaactgggtgaacgacccggacggcacgcgccaggccgtcgaacgcctgacacgcgcaacacccggcacgcccgaatgcccgatcgaaggcattccgtccgaagcgcccgcgcatcgctgaacccgcgccccgcccggccgttcgcgctgcctgcgcgaacggcgccgtctcactctggagccttcatcatgctcggtgtcgctcttttcttcatcggcgcggtgctggtcgtcaacggcgtcgcgctcaccggccgcatcgaaccgcgcgacgcggccggcctgaacctgctcgtcgggctgctcgcgctgctgatcaacctcgccggcctcgtgcaggcgtcggcgccgccgcagtttttctcgagcgcgggcgggctgctgttcgcgttcacgtacctgtatctcgccgccgtccagtggcgcgggctgcaaggcgccggcctcggctggtattgcctgttcgtcgcgatcagcgcactcgtctatgcgggcacgtcgagcgacgcgcgtttcggggcgatgtggctgctgtggtcgagcctgtggttcctgttcttcgtcgcgctcgggctgaagcggaccgtgcgcttcctgcccggctacacgatcgcgatcggcgtcggcacctgctggctgcccggcatgctgatgatgacggggaggtggtaatgagcgcacgcgatacgccgctggccaccgatccgctcgccgggcaccgcatcgccgatgtgccgttctaccagccggccggtgccgaggccgactggttcgagacggcctgccgccatcacctgccggtcctgctgaaagggccgaccggctgcggcaagacgcgtttcgtcgaatacatggcgtggcgcatgggcctgccgctgatccaggtcgcgtgcaacgacgatacgtcggcggccgacctgacgggccgccacctgctcgacgccgacggcacctactgggccgacgggccgctcacgctcgcggcacggcatggcgcgatctgctatctcgacgagatcgtcgaggcacgccccgacgcgacggtcgtgatccatccgctgaccgattcgcggcgcgtgctgccgctcgaccggctcggcgaagtcgtccatgcgcatccggatttccatctggtgatctcgtataaccccggctatcacggcgagcaccggcggctgaagccgtcgacgcggcaacgtttcgtcgcaatcgacttcggctatccggatgccgcgcacgaggccgacgtcgtcgtgcgcgaaagcggcgccgaccgcgaaaccgcgcgccggctcgtcgatcttgcgcagcgcacgcgggcgctggcgcaggcgggcaacgggctcgacgaaggcgcgtcgactcgcctgctcgtgcacgcggcaaggctgatcgtcgcggggctcgcgccgctcgatgcctgccggatcgcgatcagcgacgcggtgaccgacgacgccgacacgcgtgccgcattgcagacgatggccgccgcgcacttcgcgacatgagcgcactgccactcgcccgcttcctgcacgggatgaccgcgcacgagaccgacgtgcgcctcgacgacgcggcgccgcgcgcgacgctcggccatgccgcgctgcgcgtgccccgtgcgttgccgcccgatgcgcgcatcgcggcggccgcgcacgcgctggctcactggcggcactcgccgtccggcgagccggccgacacgctgacgcagatcggttcggccgtcgccggcgtgatcgaggatgcgcgcgtcgaggcgctgctggcccgcgaatggccggggctcgcaacgttctgggcgccggcgttcgcaccgatcggccgtgaagggctcacgttcggctgcctgtgcgcgcggctcgcgaaagcgttgttcgatccgtcgtatcgcgacggcaacccgtgggtcgacaagggcgcgcagctgttcgccgaacggcgcgacacgctcgacgactaccgtgtgtttcgcacgattgcgtcgaggctcgcgaacgatctcggccagatgcgcgtgcgcttcgagcctgacgacggcgcatggctgccctatcgcgacgacaatgcgtggctgtgggcgcggcctgccaccgcggcggccgaacaggcgggcaacgacggcgtcgagatgtcggcctcgaccggcggccacagcgacgagcgcgacgacgcaccgccgtccgcacccgatgtgccgcactatcccgagtggaattgccacacgcagcgcgaacgacgcgactggacgacgatcgtcgaacgcgcgcccgccacgtcggcgccgccgccgtcgctttccgcactgatcgacgccgaccggcgcgcggcaaagcgaatgccggccgcgcgcgcatcggagctgctgcggcgcgtgggccgccagctcgacggcgatgcgctcgacgtcgatgcggcgatcgccgcacgcatcgcccggtgcgccgggcacgcgcccgatccgcgcgtgttccgtcgccgcgtgccgcacgacgcgcgcgggcccgtgctgatcctgctcgacctgtcggcgtcgacggccgcgcaggtcgccacgctcgagaaacgcgcggcgttcgtgctcggcgacctgttcgaccggcagcggcgccgctgggccgtgcacggctacacgtcggacggacggcatcgcgtgtactacgcgcgcttcaaggatttcggcgaagcgttcgacgccggccgccgcgcggcgctgctcgcggccgacagcgggatgagcacgcgcacgggcgcggcactgcggcatgcgctggccttgctgcgccgcgaaaccgcgaatgcgcgggccgccgtgctgatgatcggcgacggcgaagccgccgacgtcgacgtgttcgacccacgctacctcgtcgaggatgcgcgtcacgcggcacgccagggccggcggcacggtgtcgcgattgccggtctgtcgttcggcgagccgcccgggttgtctacaatacttggcgtcggcccgcgctgcgtgcacgcggcgaacggcgacgcattgccggccgtcgtcgcgcacgcggccggacgactgaccgcgtgacggccccacccgtaagagacaggaacgaccgaatgaacagtgtgaaggttggcgtattgttctcgcagagcggatgcacgtcgcaccttggccggagccagttgcgcggcacgctgcaggcgatcgccgagatcaacgaagcgggcggcgcgaacggctgcgagatcgtgcccgtcgtgcgcgatgcctgttcggacccggccgtctatgcgcggctcgcagaggaactgatcgccaccgagcgcgtgaacgtgctgttcggcggatacatgtcgagcagccgcaaggcgctgattccgatcgtcgagaagtgggacaagctgctgttctacccgacgctctacgaaggcttcgagttctcgccgaacgtgatctacacgggtgcggccccgaaccagaacagcgtgcagctcgctgcgttcatgaccgcgcagttcggtgcgcgcgtgtatctcgtcgggtccgactacatctacccgtacgagtcgaaccgcatcatgatcgacctcgtcacgcagcatccggaaggccagatcctcggcgaggtctacatgccgctcgtcgcgtccgagcaggatttcgcggcggtcgtcgaggacatccgcgcgaaggcgcccgatttcgtgttcagcacgctcgtcggcgacagcacggccgcgttctaccgtgcgtatgcgcaagccggtctcgatgcacgcaggatgccgatcgcgagcctgacgacctccgagatcgagctcggtcagatgggcgcggccgcggccggccactacacgtcgtcgccctacttccagaccatcgattcggacgtgaaccggcgctgcatcgcgcagctcaaggcgcgcttcggcgacgacgcgaacgcctccgcgccgtgggaagccgcgtatttccaggtacacctgttcgccaatgcactcgcgcgcgccggcaccgaccagcgcgaccggctcgtcgaacatctcgcggacgcggaattcgacgcgccgcagggccgcgtgaagatcgaccggctcacgcagcacacgtgcctgtacccgcgcatcggctgcgcgacggccgacggcaatttcacgatcgtgcgcgaagcgacgcggcgcgtgcatcccgatccgtacctcgtcacgcattcgctcggcgaccgcgtgcacgcgcccgacgaacagaaggcgtaaccgacgatgcgcgcccgcaccccgatccgctcgacgccgcgcctgctcgccgaactgcgctcgctgcgcgtgatggtgtactacccggatgacgacaacggcctgctgctcgtcgagcagctctcgcgcatcggttgcccgagcgagcagcgctggccgccgcccgccgcgctgccggagagcgtcgacctcgtgatcctcgcggtccggcccgacctgctgcacctgtcgatcccgtggctcgaggacgatgcgcggccgccgctcatcgccgtcacgacctacgaaagcccgacgatcctcgaactgatgctgcgcatcgacgcgcagagcgcggtgacgacgccggtgcgttcgttcggcctgttgagcgcgatggcgctcgcgtgtcaccagagccggcggcacgacgaataccggcgccgcatcgcgcagctggaacagcgcgtgatgtccgctcgcacgctgcaggaagcgaagacgctgctgatgcagcacaacgcgatcagcgaggaagaggcctatcagcagatccgctcgcaggcgatggagcggcgcatctcgatcaaccagctcgccgagcagatcgtgcacgcgcatgcgctgttgaagcggtaacgcggacgcgatcgccgcgcgtcaggcgcatcagtccggcggcggcaacacgaccgtgtcctccggcccgagcacgcgcccgtcctgcgaacgcagctcgagcttcctgacgggcagcccggtcttccggtcgacgagcagcacgtgcgcctcgtcgggttcgaagaagaaatcctcgccccactgccgcaatgcgacgagcagcggaaacagaccgcgccctttctcggtcagcacatattcgtgatgcgcgccaccgtccgcggccggcacaatgtccatgatcccgtgcgcgaccaggttgcgcagacgctcggccaggatgttcttggccagtccgaggttcttctggaattcgccgaagcggcgcaacccgtcgaacgcgtcgcggacgatcagcagcgaccaccagtcgccgatcgcgtccagcgggcgggcaacgccgcaaagggaatcttcgtgcgtggttcgtctgttcatcgatgcatgaggcaatgccgttccgggaatgcggccggaacggcggttactctcgttgaaatgaatggttgcaatataaaactcgtcacacgaaagatcaatcgcgtggggctcgactgttcccgatcagcgaacgccatggccgattcgggtctcattggcacttcatttcgtacatctggcatacaaattccggcatttcccgttccggcacatcatcccgcaccaacgtgccgagcatccgtcgattgccgcggccctctttttggttgcaacttgcaacccgatatcctacgcttcgattcggtttcaacttaaaaccaaactatccgactaccgaaggagcgttcgatgatccggtccgatgccacgttcgacggcacctttcctttcaccccgcatttcgacgacgcatccggcttccggatgcactatgtggacgaaggcccgcacgacggcgaaaccgttctgtgcctgcatggcgaacctacgtggggttacctgttccgccatctggttgcggcgctgcgtccgacgcaccgcatcgtcgtgcccgatcacatgggcttcggcaaaagcgcgacgccgcaggatcgcagctactggttgcaggaccatatcgacaacctcgagcgcttcgtgctcgcactcgacctcggtcgcctcacgctcgtgatgcacgatttcggcggcccggtcggcatggggcttgccgcgcggcatccggatcgcatccggcgcatcgtgtccgcgaacgggccgacgccgttcggccagcccgatctcgtcgagcgcctgaatgcgaacggccgcgatgcgccgtggttccagtggatcatgcgtgcggcgaccgacgacacgcttgaaaccgtgctcggtcagctcggcttcaacatcctgagcacgctgaagctgaacggtttcgagaaccacgcagtcatcaccgacacgtggatcgccgcatacggtgcgccgttcgcgcaaccggcggactgtctcggcgcgatcggatgggcccgcgggtttgccgcgggcgcgcaccggttcgaggtgcccgatgcggcggcattgcgcgcgatacgcgacaaacccgcgctcgcgatctgggagacgccgaccggacgctcggcgcggaacacttcctgccgctcttcactgcgctgtttccgtccgcgcccgtcgagcggttggcgggcgtcgggcattactgtttcgaggatgcgcccgacaccatcgctgagcggatcgccggcttcatccggacgaccggctgagtgcgttccgcggcgtgcatccggcgccccgctgcggaacacggcgtgcgcggccgccttcgcacccgcgcacgcaccgcttcacatcagcgaatgacccgcgtcacaccacgcccgcgcgggtcggccatcgcctccggcgtcttgccgtcgatcttgatcacctggatgtcgccgctgaaatcctgccccttcagcgtgtagccgcgcgcctcgatctgcttcgcgagttcgccttcgatcgggtggtacggctcccagaagatcgtgttcggcggcagcagctggtgatggaagcgcatcgcgccgaccgcttccttcaacggcatcttgaagtcgtagatgttgttgatcacctggaagatcgacgtgaagatgcgcgagccgcccggcgtgccgatcacgagcgacaccttgccgtccttcgtcatgatcgtcggcgacatcgacgacagcgggcgcttcttcggttcgatcgcgttcgcgtcgctgccgaccacgccgaacatgttcgccacgcccggcttcgcggagaagtcgtccatctcgtcgttcagcacgatgcccgtgccgtcggcgatcacgcccgaaccgaaatagccgttgaccgtgtaggtgttcgacaccgcgttgccccacttgtcgaccaccgagaagtgcgtcgtttcagccttctccggcatcgtcgtgccgaggcccggctgcacgctcttcgtatccgacggctccttcgggttgacttcggccgcccgcttcgcgatataggcgtcgtcggtcagctgcgcgatcggcaccttgtagaaatcgggatcgccgagatactgcgcccgatcggcgaacacgcgcttctcgatttccgcgacgaggtggatgtactgcggcgagttgagcttcacgccctcgaagtcctgcttgaggtcggccttcatcttcagcaactgcacgaggccgatgccgcccgagctcggcggcggcgcggtgatcacgtcatagccgttccacttcgcctgcaccggctggcgccacaccgcgcgatactgcgcgagatcctcggtggtgatcagcccgttgccgtcgccggtcttcatcgacgcggcgatcagctcggccgtcttgcccttgtagaaaccttccgcgccgtcgttcgcgatgcgcgtgagcacgtcggcgagatcgggctgcttgaagttcacacccgccttcagcccggagaaatacttgtcgaagttggtcttgccgccgaactccttcgacgcgtcgacgccgcgctgcgcgagctgctcgtcgacgacgaagccatcgcgcgcatagtggatcgccggcgcgagcacctgcttccacttcagcttgccgaagcgcttctgcgcttcccacatgcccgcgaccgtgcccggtacgccgaccgcgcgcgggccgtacaggctcatgcccttgacgacgttgccgtccttgtcgagatacatgtccttcgtcgcggcgagcggcgcacgctcgcggtagtcgatgaagtacggcttgccgtccttgtagatcgtcatgaagccgccgccgccgatgttgccggcttccggatacgtgacggcgagcgtgaaggcgatcgcgacggccgcgtcgatcgcgttgccgccttccttgaagatccgctccgcggcatccgcgctgtacttgtcggccaccgcgaccgccgagctcgtcaggacagccggctgcggcccttcgcatagacgggtgcgttcggcaggaaaccgatgccggccaccgtcgcgagcacgacagcggatgatttgaagcgattcagcgtagtcattgcatgtccccatgtggatctccttcaggcaggaaaagcacctgtccgcgcatggccgccggcgcaccgacggccatatccggtttcgtagtataggggacaaaagggtcgaacacgtgacatgcgatgaaagcgcattcgctgtgtgcgcctggtcatgccgctgcttctcgacacggatgcggacaggtcgaaattgcaccgggcgcgcggccgcaattcacaccggttcacgtcatcacgcagcgcacaaaaaccgaaagttgcgaactgcgcgacaggccacgtgacgcgtgaaaaaatctgcaaacgtccgtcccgctgcacgatccgatctgcgaagatagcgccccgctttcacaccgcatcactggttcgttcacgcgccgcctcacgtttcttcgtctcgcttcctatggcatcacacaacgcgcatcatgcgtccggcttcgcggccggcgtcgccgccgccgccctcgtcgcacaaaccggcgccacgggcccgtggcattcgggcatgttcgccgcattcgcggcgggcgtcgcgggcggtaccgcgcccgactggctcgaagtcgcatggtggcgccgcaagcgccgcctgtgggtcacgcatcgaaccatcacgcactggggcatcggctggatcgccctgctcgcactcggctggcacgggctcatccatcatccgcatccgctgtgggccgcgccgctgttcggcttcgcatgcggcggcgtgatgcacctgctcgccgactggccgaacccgctcggcgtaccgtggatctggcggcgtcattcactcaacctgtggaacagcgggcgttgcgacctgatcgtcgtgggcgccgcatggggcggtacgctgtggctcgcgcagtcgttatgctcgcgtacgccgctgctcgaacactggctcggctggctgcatcgcgtctagttgcaattcggcgcaatttgacgcgattcggcgtgctatcggcacgccggcgcgcatgcaactttccgtccgttgaaagtacggtgcaggcccccatttgagtccggaccgccgacacgcgcacccggcacgcacgcgcgacgtctggcacactgacgattcgattcgtgcgcgccttgcgcacgctttgcgccctgcttgcaccctatttcaacgctccgatggacgtcaccgctacccgccctgccgcccgtgcgctcgacgtgttccacccggccgtcgccgcgtggttccggcgcacgttcgccgcgcccaccggcgcgcaggcgctcgcgtggccgcacatcaaggccggccgctcgacgctggtcgccgcgcccaccggctccggcaagacgctcaccgcgttcctgtgcgcgctcgacgatctggtgcgcgatgcgctcgcgcatgacggcacgctgcccgacgcgacgctcgtcgtgtacgtgtcgccgctgaaggcgctgtccaacgacatccacgtgaacctcgatgcgccgctcgccggcatcgccgattcgctcgcgcaactcggcctgccggtgccggcgatccgcaccgccgtgcgcaccggcgacacgacgcaggccgagcgcgcggcgctgcgcaagcgcgcgccgcacatcctcgtcacgacacccgagtcgctgtacgtgctgctgtcgtccacgtcggggcggcagatgctgtcgaacgtgcgctcggtcatcgtcgacgagatccacgcgctcgcatcgtccaagcgcggcagccatctcgcgttgtcgctcgaacgtctcgacgcgctggccggccgtgcgctgccgcgcatcgggctctccgccacgcaaaagccgatcgatgcggtcgcgcgcttcctcgtcggcgggccggccgacgcgccgcgcgattgcacgatcgtcgacacgggccacacacgcgagcgcgacctcgcgctcgaactgccgaacgtgccgctcgaacccgtgatggccaccgacgtgtgggaacaggtgtacgaccgcattgccggcctcgcggccgcgcaccgcacgacgctggtgttcgtcaacacgcggcgcaccgccgagcgcatggcgcgccatctcgccgaccggctcggcaaggatgcgatcgccgcgcatcacggcagtctcgcgaaggagcaccgcttcgacgccgaacagcggctgaagcgcggcgaactgaagctgctcgtcgccaccgcatcgctcgaactcggcatcgatatcggcgacgtcgatctggtctgccaggtcggctcgccgcgcggcatcgcaccgttcctgcagcgcgtcggccgctccggacaccatgtcggcggcgtgccgaaggggcgcctgttcccgctgtcgcgcgacgagctcgtcgaatgcgcggccctgctcgattgcgtgcaacgcggcgagctcgacgcgctgcggattcccgaagcgccgctcgacgtgctcgcgcagcagatcgtcgccgaagtagcgtgcacggaatggcaggaagacgcgctgtatgcgagcttcacgcgcgcagcgccgtacgcgcggctgacacgcgagcgcttcgacgaagtgatgaagatgctcgccgaaggcttcacgagccgccgcggcgtgcgcggcgcgtacctgcatcgcgacgtggtcggcggcaccgtgcgcgggcgccgcaacgcgatgatgaccgcgaccacgtcgggcggcacgatccccgacatggccgactacgcggtgctgctcgaaccgcagggcatccaggtcggcacggtcaacgaggatttcgcgatcgagagcctcgcgggcgacgtgttccagctcggcaaccagtcgtaccggatcattcgcgtggaaacgggccgcgtgcgtgtcgaggacgcgcagggccagtcgccgaacattccgttctggctcggcgaggcgccggggcgcagcgacgagctgtcggcggcggtcggccggctgcgcgcgcggctcgacggactgttcgcggacggcgaccggctcgcacatggcaagaaccgtgaacgcatcggtgaagggactggcggaaagcccgcgccccggaccgacgtcaaagcgggtgcgaaggcgaaatcgaaggccgggatcgaagccgataccgacgcctcgaccggcttgcggcatgacaccgtcgtcgccgccgccgaaagccggctcgcgccggcgttgcgctggctcgtcgacgatctccgcctgtcgcccgacgccgcccgccagatcgtcgactacctcgcccgcacccgcgccgcgctcggcgcgctgccgacgcaggacacgctcgtgatggaacgcttcttcgacgaatcgggcggcacgcagctcgtgatccattcgccgttcggcagccgcatcaaccgcgcatgggggctcgcactgcgcaagcgcttctgccgcagcttcaacttcgagttgcaggcggccgcgaccgacgacgcgatcatcctgtcgctgtcgctcgcgcacagcttcgcgctcgacgaagtgtggcgttacctgcgttcggccagcgccgaacacatcctcgtccaggcactcctcgacgcgccgatgttcggcgtgcgctggcgctggaacgcgacgacggcgctcgcgctgccgcgcttcaccggcggcaagcgcaccgcgccgcaactgcagcggatgaagagcgaggatctgctcgcgaccgtgtttcccgatcaggtcgcgtgcctcgagaacatcgtcggcgaacgcgagataccgcatcacccgctcgtcgaccagacgctcgacgactgcctgcacgacgcaatggacaccgacggctggctcgcgctgctgcgccggatcgagagcggtgcgatcgagctgatcgcgcgcgacctgcccgcgccgtcgccgctcgcggccgagatcctgaacgcgaaaccgtatgcgttcctcgacgatgcgccgctggaagagcgccgcacgcaggccgtgcagtcgcgccgctggagcgatcctgaatcggccgacgatctcggcgcgctcgacgccgacgcgatcgatgccgtgcgcgacgaagcctggccgctcgtgcgcgacgccgacgaaatgcacgacgcgctgctcacgctcgcgtgcatcgccgacagcgaagcacacgcgcacgaaggctggcccgagcggctcgcggaacttgccgaacgccgccgcgcgacgaaactcatgacgcccggggcgccctgtgggtgccggtcgaacggctcgtgtgcctgcgtgcgctgcatcccgatgcccgcgtcgcgccggcgctcaaggtgccgcctgcctgcgcgcagccgtgggaagcggatgccgcactcgtcgacgtgatccgcgcgcgtctcaccggtttcggcccgcttgcactcgacgcgatcgcgacaccgctcggcctgccgcctgcgtcggtcgcgacggcgctcgcggcgctggagcgcgaaggttatgtgatgcgcggccggttcacaccgggcacgacgaccgacgaatggtgcgaacgccatctgcttgcacgcattcatcgctatacggtgaagcggctgcgccgcgagatcgaaccggtcgaacgcgccgacttcatgcgcttcctgttccattggcagcacctgacgcccgacacgcgcggcaccggccgcgacgcgctcgctgccgtcgtcgaacaactcgaaggcttcgaggccgcggcgagcgcatgggaagacgcgctgctgcccacgcgcctcaccgactacacggcgggcgggctcgacgagctgtgccgctccggcaagctcgtgtggacgcgcatcggcgcgccggcccgcgcagccggcacgcccgttaagacgacgccgatcgtgctgctgccccgccgccacctctctgcctggcaggcgctgcgcgatcccgacgcgcaaccggcgctgtccgcacgggccgcccaggtgcgcgacaccctcgccgcgcacggcgcgatgttcttcgatgcgctgctcgacgacctgcacatgctgcccgtcgaactcgaacaggcgctcggcgaactcgtttcggccggcctcgtgaatgcggacagctacgcgggcctccgcgcactgctgaagcctgccgtcaagcgcagcgcgacctatgcgccgcgcacgcggcgcggcggtgcgctgatcggcggaatggacgacgccggccgctgggcgctcgtgcaacgcgcttcggcaccggccgacacgccaacgccggcaccgaagcgcggtgcgcccgcgaccgatcccgacgcactcgaacacatcgtctggacgctgctgcgccgctacggcgtcgtgttctggcggttgctcgaacgcgaagccgactggctgccgaactggcgcgagctcgtgcgcgtgctgcaacgcctcgaagcgcgcggcgagattcgcggcggacgcttcgtcgccgggctcgcgggcgaacagttcgcgctgcctgaagcgatcccggtcctgcgcgaactgcggcggcaaccgggcgacggacagtacgtttgcgtgacgggcgccgatccgctgaatcttgccggcacgctgctgcccggcgacaaggtgccggccctcgcgggaaatcgcgtgctgttccgcgacggcgtgcccgtcgcctcgctggtttccgggcgttccactacgccccgaactgtcgcccgccgcgcgcgaggatgcgcgcctgcggctcgcgcgcagccactgacatcggctgacacgcaacaccacaccgactactgatcgcggggccgcgcgaccgcctgccttcgggtagcatcgaacgactttccgcgcgggcgcccgcgctccagcacaacaagatttccggagactgctgtccatgccctcgcacgccgactcgcccgccgctcatcacgcgggctcgctgacgattttccagggcgccgcgctttatatcggcgcggtgctcggcaccggcgtgatcgcgctgcccgcgctggccgccgaggtcgcgggcccggcatccctgctcgcgtgggccgcgctggtcgtgttgtccgggccgctcgcggccaccttcgccgcactcggcgcgcgctatcccgatgctggcggcgtctcgacctacgcccggcgcgcattcgggccgaaagccgcggcggtcgtcggatggtgcttctacttcgcggtcccggccggcgcgccggctgccgcgatgttcgccggcgcatacgtcgcggccgtgacgggcggcgggcacacgaccgtcgtcgttaccgctgccgcgctgatcgcgaccgtgtcggccgcgaatgctttcggtgtcaccgtttcgggccgcatgcagctcgtgttgtcggcgttgctcgtcacgctgctgctcgcagcggtgctcgcctccgcgccgcatgcgcgcacggcgaacctgcatccgttcgccccgcacggctggctctcggtcggccaggccgccgcgctgctcgtgtggagtttcgccggctgggaagcgatcacgcaccttgcggccgagttccgacggcccgcgcacgacatgccgcgctcggccggcatcgccgtcgtggtggtcgggttcctgtatctgtcggtcgccgccgcgagcgtgacggtgctcgggccttccgcgggcgcatcggggcgccgctcgccgaactgatcgcaggcggcatcggcggtcatgcccaggtgctcgccgccgcggccgcgctgctgctcacgctcggcacgatgaacgcgtatttcgcgggcgcggccaagctcggtgcggcgctcggtcgcgacggtgcattacccgcgtggctcgcgcaaggcagccaggtcggcggcgtcccgcgccgcagcctcggcgtgatcgccacgctcgcagcccttgcgctggccgcgacgacgctctcggacgtcgggcccaaaccgctcgtgctcgtgacgtccggatgtttcgtgatggtgtatgggctcggtgcggccgccgcgctgaagttgctgccgcgcggcggcatcgcttaccgctgtgcgtgggtttcgctggttgcggttgccgggctgttcctgacgaccggctgggccatcctgtgcccgctgctgctcgcgggcggtgcgctgctctatctgcgggtgaccggaccgcgccggtgacccggcatgtgcgcgcgggccggcactcgccggcttgcggcgacacgccggcgaatcatggccgacccgccggccggagggccggccactgcgccgtgcgcatcgtgcgcatcacacgtacggtcgcgaacccggccatacgccgctgcttcacgctcgtcaggccggcaccagctcgaagctgagccgtttgccgagcgcggcggccgcgctcgcgagcgtcgcgagcgtgaggctcgtgtcggtttcgtcgagcagccggttgagcgcggcgcggctggttttcatccgcgcggccatcgcggttttcgtgatgtgctgcgccttcatttcctgcccgatctgccacgcgatcacgcgcttgatcgcggtggcggtggccgcttcgagattgccgtcctcctcgaggaaggtatcgaaatcgctgccgatatgcggatggttcgtggtcgtcatgaggtactccagtgcatggcgttgccggctgcctgcccgtcgaagacggtgcgttccggcgcaaccgggaaattcagatggcatgcgtcaacgctttgagacgcgcgacggtgacatcgagatcgtccgacggcgtggcccgcgactgcttgaagaagccgtgcagcaggaccatcgtgtcgccgacgaccgtaaacagcacacgggcgctccgccccggcagcgccacgcggatctcccacagatccggtgccatcttccggaccagcggcatgccgagcggccagccgagttgaacggtcttgatctcctcgccgatcacccttcgctccgcttgcccaagcgacttcagccattcgcgcaccggctcgttgccacgagccgtctggaagaaccgcacgccgagcgtgacctggatctgctgtctcgtcatcgtcttgacaccaatcgtaccaaaatcggtacgataagccaagcactaccgggacagctactggccggacggccaattcgatagccggggacggctcggtccgcgcttgccgcgcgatctgccccgggttattcgtcgcgatgagcccgcttgcgcgtcgcgcgtggcgactggtgcgctcgcgcatcgccgaaccgcgaccgcgcgaggtcgcgcacggcatcgatcagcgtccgcgcgaccggcgacggctgcgcatcggtacgcaggatgagcccgaccggctcgtcggtgcccgcggacggcaacggcaggcgtgccagcgccccggccgacaggtcgtattcggccgcatagagcggcacgaaccagaccgcatcgttctcgagcgtcagcgcgcgcgcgaccgataccgacagcacctcgatgaacgaatccagcggcggcgcgccgcaggcgccgagcaactgctcggccgactggcggatcagcgtgccgaacggcggcagcacgaccggatggcgtgcgagctcggccgccggtgccgcgcttgaaagcagcggatgcccggcacgcacgacggcaaccagcggctcgttgtacaactgctcgaacgcgagcccgatcatccgctccggctccgacagccgcccgatcgcgcactcgatcgcgcccgacttcaggcgctcgagcagatcggcattcgcggccgtcgcgatccgcacgacgacgcgcggccagcgcgcggcgagcgccttcatcaacgccggcgcaagcgatgccgcgaccgtcggcagcatgccgatttccagcgtcgccgcggcggctccgccctcacgcgcaagcagcccgacaccctgccgcagcgccagcacgcacgcgttcgcatgcggcatgaacagctgcgcctcgcgggtcggctgcgcgccctgccggccgcgctcgaacagcttcacgccgaggatcgcctccagttcggcgatcgtcttcgagacggccggctgcgtgatcgacaggctttccgccgccttctgcacgccgcccagctgcgcgaccgcgagaaagcactgcaggtgccggaacttgacgcggccgtcggcgatacggttattcataacgggtggttatgcgattgacgatgaaacgccattttgcataactttccggatcgccccaagcgttcgacgaggcatcacgcgcgacgccgcagggcctggaaaccggccggctcccacatccgcttcgcgatcagcaagctcgtcccgtgcttctgcgcgagcggcgcggacgacgattccgcatgcagcgcggccgccttgctgcgcagccggcgcaactccagctcgagctccgcggcggcagcctccgtcagcatcccctgcaagaacgtcatcgtctcgccctccccgtcgaagcgactgtcgagaaaatcgccgagcgcgtgcgcatggaaataacggcggatcggcccgccgggcagccagtcgaaatcgcgcgcgacgcgcacgcgaatccggtcacccggcagcagcgcgacgacgttcatccggtcgagcatcagcaggtatttcacgcactcggcctgggtcacctgataggtcgacacgatgtcctgcacggtccagtagttgatcgcgcaaacggcaacgagcagcagcttgtcgtccgacacgagcagcgcctcctgctgctcggtcagcacgcgcagcctcggcgccgacgcggaagcctcctgcacgagttcggcgagcgtatagccgagcagctgggcgatctccacgacacgctccagcgtgaagcggccgctggcgaacagccgcttcacgctcgtctcggagacgtcgagcgcccgcgcgacgtcgcggtaggtcatgccctgcgccttcaactggcgcttcagcatttcgatgagttgggcggtttcggtcattttggtatcgaaaaatgatgctcaaggtcagatattaggctacctgcacacgcaaatgaacactttcggatacttgtctgcataatccgctccgtgctgtcaccgaacgacggagccgaaatgaccacccgaaccgaaaccgccgcctacgaatcgcgccacaccgccccgcgcgatgcacgcgacacggatcgcacgatgccgctcgccacgatccgcacgctggccgccagcgcgcacgtcggggatctcgtgttcatccgcgtgccggcgagcgcgccgcgcgacgcggcgggcacgatgggcacgtgggccaatcgcttcggcatcgtcgtcgatacgtcgggcgacgaacccgtgatcgccgaatccgggtttgcgtggacgaaactcacgccgctgtcgcgcttcgtcgcccgtaccgacggcgggcgcatcgcgctggcacgccgcgtcgcggcaccgaccgccgacgcgcagcgccgggtgcatgcaacggcggaacagcggatcgacgcgctgctcggcaaccgcttcaacctgcggacgcggcgcgcgttctgcgcggactacgtgagcgacgtgctcggcgccgaccgggacgcgacgcctgcggcactgctgcgcggcggcacgctgtcactcgaattcgacgggatcgtgttcgatccctgccgccagtcatgacgggcgcgctcaggaggccggataacaacaagaacgaaaacacaaaaagcagcgacgggctggctggagggccgtgcacgggtcgtcaccgacgacgcgaagcccgatcgctttccgccggacaggcatcctgtccggcggaattttcattggcgcgtcgaacataacgaacggttatgcgattcgcgaaaaaggtcattttgcataactttccggattggctaaagtcctgccatccacttcgcgaaatacctatcaggagacgcccgatggattccccacgatcctcacgccgcgcgactggccgtcgcatccggcctatatccaccccgagtaccgttcgtccgtgaagcgcggcccgacccgcccgctgatcccgctgaaggagaaactgcgcgaccagtacgcgcccgtctacggcgccgaggatctcggcgcgctcgaccacgacctgacgaagaacgccgtgaagaacggcgagccgctcggtgagcgcatggtcgtcacgggccgcgtgctcgacgaaggcggcaagcccgtgcgcaacacgctcgtcgaggtgtggcaggcgaacgcggccggccgctacgtgcacaaggtcgaccagcacgatgcgccgctcgacccgaacttcctcggcgcgggccgctgcctgaccgacaacgaaggccgctaccgcttcctgacgatcaagcccggcgcgtatccgtggggcaaccatccgaacgcgtggcgcccgaatcacatccatttctcgctgttcggcgattacttcggctcgcgtctcgtcacgcagatgtacttccccggcgacccgctgctcgcgtacgacccgatcttccagggcacgcccgaggccgcgcgcgaccgcctgatctcgcgcttctcgatggacatcaccgaagaaggctatgcgctcggctacgaattcgacatcgtgctgcgcggccgcgacgctaccccgatggagcgctgaaccatgacgacgctgaagcaaaccccttcgcagacggtcggcccgtacttcgcgtacggcctgtgcccgcagcaatacgactacgacctgaagagcctgttcacgccgacgatcgccgcggcacacgccgaaggcgagcacgtgctgctggtcggccaggtgttcgacggcgacggcaacgtcgttggcgacgcggtgctcgaattcacgcaggtggacagcgcgggccgctaccccgcgtcgcgcgacgacatcgcgaaatccggcttcacgggcttcgcgcgggtcggcaccggcaccgatgcgcagcagcgcttcgtcgtcgagacggtgaagccgggccgcatcaccgccggcgaggcgccgcacatcaacgtgaccgtgatgatgcgcgggatcctcacccatgcgttcacgcgcgtgtatttcgacgacgaagccgccgcgaacgccgccgacccggtgctgaacgcggtgcccgccgagcgtcgcgcgacgctcgtcgcgaaacgcgacgcgcaaccgggccgcccggtcgtctaccgcttcgacatccgcatgcaagggcccgacgaaacggtgttcttcgacgtgtgacgcgcgagccggcgcacgccggcttcgcccgctaccgcaaaccgcaacgccgcgtggcgcgataccgacaggcatcgcgccacgcggcgtttttcgtgttgcggcgccatcatttgatgctgcatcgcagcacgccaggccgcgggcatcgatgcccggtgccggggctgccgcccccgcatcgaacgcgcgattgaaacgcatgctgcgactgcacataaatcatcgccccggcaggatatcgtttgcgcgttatgcggcgtatcctgcgttatccgcaacgttcaaacggaattaaatcaggatcggcaacaattacgcatgtcatgcgcgatatcgacccaccgggccgtgcgcgcatttttctgaccgagtgcctttaagcgcgtctgaccgaagttggcagacgcgtattttttgcggcgaccggcacatcggcgttgtgcgctcggatgccttccggtcagcgccgaatctccagatagcggctcggcgtatcgcccagaatgcggcgaaacgccgacgtgaacgcgctggcgctcgcgtacccgagatcgagcgcgacgcgcgtgaccggctgcccgtcgctcaggcgggcgatcgccgcgagcatgcacacctgctggcgccatgcggcaaaactcacgcccgtctgcgcgcgaaactgccgcgtgaacgtgcgccggctcacgccggcatcggcggccacctggtcgagatcggccgcgatcgacggcgacgcgagcaggtggcggcacaccttcgccagcctcgcgtcggccggcagcggcgcatgcagcgacaggcgcggcatcgtcgcgatttccgcgaccagcagcgccatcagcttgcccgcgcgcccgtcgacgtcgtacagggccggcaggtcgatcgcatcgtcgatcagttgccgcagcagcgccgatacgccatagacgccgcattgctcgggcaggcccgcctcgagcgcggcgtcgccggacacgaacgtgttgagcatcgtgaccggcccggtcatcgtcatttcgtgccgcacgccggccggcacccagcacgcgcgctgcggcggcaccagccagcgcccgtgcggcgtcgacacgctgatcgtgccgcgcgacgcgaacgcgaattgcccgcgcacgtgcgcgtgctccgaaacgtcgtacccgccgcgtagtcgttcgcggtcacgaccacgctccgcggaatgtgttcgtagggatctagcagcgtatttctcacggcccgaattccatcatcaatgacccgatatcgaaggcgggtctccttcgcgcgatctacgatccgctccaccctgcgcgacctcgcggccgcaagacccgtcggcctgatcggccggattaccactgcatcggagcggacatgccgaatacgtttcatcgcgtggggacggcccccaccctgttcttgtactgcccggctggttcggcgacgcccacgcgttcgaacccgtcgaagcgtggctgtcgcgtgagcgtttcagctatgtgttcatggactaccgaggttacggccgcatgcgcgacacagccggcgactatacgatcgacgagatcgccgccgacgcgctcgcgcttgccgacgcactcgaattcccgaccttcagcgtcgtcggccactcgatgggggcgatggcggccgagaaaatcgccgtcatcgcgcccgaccgggtgcgcgcgctcgtgccggtcacgcccgtgccttgcggcggcctgccgttcgacgcggagaaacgcgcgctattcgagcgagccgccgaccacgtcgccgatcgccggaccatcatcgatcgcagcaccggcggccggctgcccgccgcctgggtcgcgtggaaagccgcgtattcggcagcccgttcgtcgccgccggcgttcggcgcgtacttccgcgcgtgggccgatacggatttcagccacgagatcgccggcacccatccggtgaaagtgctgatcggcgagcacgatccggcgttcgacgcggcgctgatggcccgcacttacctgcggcgctacccgcgcgccaccgtcgacgtgctgcgcaatgcgggccactatccgatgaacgagacgccgctcgcgctggtcgcggccatggaaacgttcctgcttgccgtgacagcgagccctgctaccgcccattgaccggtcgcacgccggcgacatcgccgcggcacgcatcaccgcagcatgaacgacatcgcagacaggctgttcaacgtgcgcaccacgtgctcgaccgaaggcccgtcgaagcgcagcgtcaccgcatcgacgcgctccagcgacggcagcacgcagaacaggtcggccagcgctgccgtctgcacacgcaacgtgcaggcggccggcgcgggccgacgggtgccggcgcgcacgcctgccgacagtgcctgtacgaccgtctcgcgcgcagcggctgcgatccgcgcacacgatgcggacggcgtgagcgtatcgccgctcgatgcgccgccggccgtcttgaccgtctcgaaatgcgcatccggaaacagcggctgcgtttcttccgcgaacacgtcgtcgccggtggccagcgcgacgtgcgcgccatattcgcgggccagcgcgccgtacagcccggcttcgccgagctcgacgccgttcagccacacctgcgtgaacgcgaagctgttgatcgtgtgcgcgaggatgccgcgcgtctgcgatttcgcgtgatagccgatcatgaacacgaggtcgggctgctgttcgaggcccgccatcatcccgagcgtgcgcggcttgccgagcacgacacgcgcacgcgcatcgagcccgtcgggcagcaggttgcggaaaccgccgtgcgaatcgttgacccacacggcctgcgcgccgcccatgaacgcgccttcgatcgccgcattcgcctcggcggtcatccagcgccgcgcgcgttcgtattccggattgccggcacgcgtctgctcggtggcgaacacgccggcgacgccttcgatgtcggtcgaaatcaggatcttcatgactgggcaatacgtccttcgtgactttcgttgaacaggcgatcgaggtcgggcaccgcatcgcgcagcgattgccgcacgtggccgtcgcgcccggccaccgtcacggcctgcagcaacgcatcggcgatggcgtgctcgacgctttcggcggcagccatgaacagcggatcgagcgccgcgtcggcgacgagggccggcagcgcgatggtcgacgcgtcgtgcgcgatcgtgtaggcggtggagaaggcgagcgcgatgtcgccgctaccgtgcccgtagaccgagcccgtgcgggccagccccgcgcccgcacggcgcgcgagccgcgacagttgccgcgcgtcgagcggcgcatcggtggccagcaacaggatgatcgagccctgttcgggtggcgccgcgtgcgcggcctcggccgcccgccgttgcgcgacgatgcgcccgagcggcacgccgccgagcgtcagcatcggcagccggccgaaattcgcgagcacgagcgcgccgaccgtatagggccgcccggccgcgaccgcaacgcgcgacgccgaaccgatcccgcccttcaggtcgaagcacgacatcccgcgcccggctcccaccgcgccgcgcgcgacgtcacgcgacgccgcgcggcacgcgtcgtcgtaatgcgcggccgtgaccgcgaacgcctggatatcgttcagataaccgtcgttgcactcgaacacgagcgggttgacggtcggccagtcgcggccgatctgcggattcgcggcgatcgccgcgtggatctgcgcgtttgcgagcgcgccgacgccgaacgtattggtcaacgcgatcggcgtctcgagcgtgccgagctcgtcgacctgcacgagcccgacgctcttgccgaagccgttgatcacggcggcccccgccggcaccttgctgcggtatacgtcgcccggatgcggcttcacgacggtcacgcccgtctgcacgttgccggcatcgagcgtgcaatggccgaccgtcacgcccggcacgtcggcgatcgtgccgcgcggcccggccggcagcgtcgccgtccacatcggtgcgatgcgcatcagcggcgctccagcttcggatcgagcgcgtcgcgcagcccgtcgccgagcaggttgaacgcgagcacggtcaggaagatcgcgaggctcgggaagatcgcgatgtgcggcgccgtcaccatgtccgcgcgcgcctcgttgagcatcgcgccccactccggcgtcggcggctgcgcaccgagcccgaggaacgacaggctcgcggccgtgatgatcgacgtgccgatccgcatcgtgaagtagacgacgaccgacgacacggtgcccggcaggatgtgccgcatgatgatcgtccagtccgatgcgccgatgctgcgcgcggcctcgacataggtcatgtgcttgagcatcagcgtgttgccgcgcacgagccgcgcgaacgccgggatgctgaagatcgcgaccgcgcagatcacgttgaccatcccgttgccgaggatcgcgaccacgccgatcgcgagcaggatgcccgggaacgcgaacagcacgtcggccacgcgcatcgtgatgcggtcccaccagccttcgtagtagccggcgagcagcccgaagaacgtgccgatcaccgcgccgagcgcgacggagaagaagccggccgcgagcgagatgcgcgtgcccgtgatgatccggctgaagatgtcgcggccgagcgaatcgacgccgaaccagtgcacggccgacggccccgcgttcagggcgtcgtagtcgaaatagttctccggatcgaacggcacgacgtgcgggccgatgaacgccagcacgacgagcgccagcacgaagccgcccgcgacgagcgcgacggtctgcttgcggaacttgcgccagaattcgcgccacggcgtgcggatcgcggtgggtgcggccggcgccgcggtctggacagtcgcgttcatgcgcgcctcacttgaaccggatggtcgggttgatgaccgcgtacagcacgtcgacggtcaggttgatcaggatgaattcgagcgaaaacagcaacacgatcgcctggatcacggggtagtcgcgcatcgtcacggcatcgacgagcaggcgcccgagccccggccagttgaacacgacctcgacgacgatcgagccgccgagcaggaagccgaactgcagccccatcatcgtgacgaccgggatcatcgcgttgcgcaggcagtgcttgagcaccaccatcggctcgtgcacgcctttcgcgcgcgcggtgcgcacgaaatcctcgttcagcacctcgacgaacgacgcacgcgtgaagcgcgccatcacggccgcgaccgcggcgccgagcgtcagcgacggcagcacgtagcttcgccacgaaccgtccggcacgacgggcagccagccgagcttcaccgagaaaatttccatcagcagcatgccgagcgcgaacgcgggaaacgagatgcccgacaccgcgagcgtcatgccgacgcggtccggccagcggttgcgccacacggccgacgcgatgccgatcgccatgccgaaggccgtcgcccacgccatgctgacgagcgtcagcatcagcgtcggcatgaagcgctcgccgatctcggtcgaaaccggccgcttgctgcgggtcgacaggccgaaatcgccgtgcgcgatcttcacgaagaagttcacgaactgcgcgggcagcggctggtcgaggccgagatcggtgcgcaccagcgcgaccgtcgcgtcgtcggcttcgggcccggccgcgagccgcgccgggtcgcccggcagcaggtggacgaacaggaacaccagcaccgcgacgatcgcgagcgtgggcagcaggccgaacaggcgtttgacgagaaaattcagcatggggcaccgatcgaatcagcgtgccggcggcttgtgccgccggcaccgcgtggcggacgaaccgccgtcatcaccactgtcatttcagcgagatttcgtcgaagttgaacgagccgtccggcatcacgtacgcaccctgaagccgcttgctgcgcgcatacacgatcttctcctgcacgaggaagatccacggcgcatcggcccagatctgcttctgcgcatcggcgtagagctcggccttttcgtgcggtcgaccgtctccagtgccttcgagagatcgccgtcgaccgcgtcgttcttgtagtacgcggtattcaggagcttcggcggcgccgacgagccggcgagcagcggcgtgatcgcccagttcgcctcgccggtcgacgacgaccagccgatgtagtacatccgcaccggcgccttcgccggatccggcgcgctctcgaccttcgcgacgcgctcgccggcttccagcgcctgcacctgcaccttcacgccgacctgcgcgagctgctgctgcacgaactggatcgccttctgcgacgtcgagttgttataggcggaccacagcgtcgtctcgaagccgttcgggtaaccggcctccttcagcagcgcgcgcgcttcgccgggtcgtacggccacgggcccggcttcgtcgcgtagtcgacgccctgcggcaccacgccggtggacggcgtcgcgaagccggcgaacgcgaccttcgcgagcgcttccttgttcaccgcatagttcagcgcctggcgcaccttcgggttgtcgaacggcttctgctgcaggttcagcgacacgtagcgctgcacgatcgacggccgctccacgacgtcgaccttcgggttgcccttcaggtcggcagcctgctcgaacggaatgcggaacgcgaaatcggcctcgcccgtcttgatcagcgccgcgcgcgtgttgttgtcgaccaccggcttccagtcgatcgcgtcgatcttcgggtagcccttcttccagtagccggcgaacttcttcaccttcaggtcgtcggtctgcttccattcgacgaactcgaacggcccggtgccgaccggatgcagcgcgatgtcgcggccccacttcttcagcgcggccggcgagatcatcacggccgacgggtgcgcgagcgtgttgatcagcgcggagaacggctcgcgcagcgtgatcttcaccgtgtacggatcgaccacttcggtcttctcgatcacgcggaacatgttgtagcgcttcaggtggttcgcgggatcggtcacgcggtcgaagttcgccttcacggccgccgcgttgaaatcggtgccgtcgtggaacttcacgccctggcgcagcttgatcgtgtaggtcttcgcatccgggctcgcgtcgtagccggttgccagcacgttgacaagcttcatgtccttgtcgaagccgaacagcccctggtagaacgacttgacgacggcttgcgacaccgtgtcgttcgcgtcgtacgggtccatcgtcgtgaacgtcgaatccaccgccatcaccgcggtctgctgcgcgaacgcgggcaccgcggccgacagcgcgagcgcgccggcacccgctgcgagcagtgcgcgtggacggaacatcgggaacgaatacggcttgttcatcttgctgggctcctgtgggtgattcgataacgcgtggtgagagtcgcggcgggacggcgcccgctcggggaaaatgcgtcgttgcctcgctcgtgcgcaactgcggtccatggcaacctgcgcgcggtcagtacgcgccgccgacgcggtgcgtcgcgacgtagtgatccggcccgaccgcgacgagcggcgcgacgaccggctcgtcgccggccgcgcggatcgggctcgggatttcgtccgccgcgagctggcgcggggcgtgccggcgcgcggggtcggccaccggcaccgcgctcatcagcttcttcgtgtacggatgctgcggcgcctcgaacaccgcgcggcgcgggccgatctcgacgatctggccgagatacatcaccgcgacgcgatggctgatgcgctcgacgacagccatgtcgtgcgagatgaacaggtacgcgacgccgagttcgcgctgcaggtcgagcatcaggttgacgatctgcgcctgcaccgacacgtcgagcgccgacaccgattcgtcggcgatcacgaccttcgggttcagcgcgagcgcgcgcgcgatcgcgatccgctggcgctggccgcccgagaattcatgcggatagcgacgcgcggcctcgggcggcaggccgaccttgtcgagcagccagtcgacccgcgcctgcgcttcgcggccgctcgcgacaccgtgcacgagcagcggctccatgatcgagaaacccacggtcaggcgcgggttcagcgatgcgaacgggtcctggaagatgaactggatgttccggcgcagcgcctgcaggtcggggcctttcagcgcgctgatgtcgcggccgtcgaactcgatcgagccgctctgcgattcgacgaggcgcagcagcgagcggccggtggtcgacttgccgcagcccgattcgccgaccagcgcgagcgtctcgcccgcgcgcaactcgaagctcacacgctcgaccgcatgcacgtattgcgacacgcggccgaacacgccgctcttcaccgggaagcgcgtcacgagatcgcgcacgcgcaggatcggcgacgcggattgatcgaagcccggctgcgcaccgtcgttcgccgccggtgcgggcgccggcgatgccgccggtgctgccgtgtttgcaccctccaccttcagcagcgggaatttctcgggcgcgtcggtgccctgcatcgagccgagcttcggcacggccgcgagcaacgcacgcgtatagcgatgcgcgggcgccgcgaagatgcgatccgattcgccctcctcgaccttctcgccgcgatacatcacgagcacgcggtcggccacttcggccaccacgcccatgtcgtgcgtgatgaagatcacgcccatgttcatttcgtcctgcagcccgcgcaccagttgcaggatctgcgcctggatcgtcacgtcgagcgcggtcgtcggctcgtcggcgatcagcagcgcgggccggcacgacagcgccatcgcgatcatcacgcgctgccgcatcccgcccgacaactgatgcggatagcgcgcgaacacgcggcgcgcctccggaatgcgcacgagttcgagcagccgcagcgtctccgcgcgcgcttccgatgcactcttcgactgatgcagcgcgatcgcctcgctgatctggtcgccgaccgtaaacaccgggttcagcgacgtcatcggctcctggaagatcatcgcgatgtccgcgccgcgaatgccgcgcatcgtcgcaccgcttgcctgcgcaagatcgacgagcgcgccgccgcgccggcggaacgcgatccggccgttcgtgatcgcgccgccgccgtgctcgacgagccgcatcagcgcgagcgacgtgaccgacttgcccgagcccgattcgccgacgatcgcaagcgtctcgccgcgatcgacgtgaaacgacacgttgcgcaccgcgtcgaacgtcgcgccttcgcggcggaacgtgaccgacaggtcgtcgacggccaccacgcgctgctcgggcagcaccaggccggacgggttacggctcgaagtcatcgtggatttcctcttcgtgctggccgggatcaggccgtgtcgtcgtcgcgatagatgccgaccaccggcgcttcgccgacgcgcgcgtaaccgcgatacatcccttcggtgttgaacggcatcgcgacgttgccctgcgcgtcgaccgcgatgatcccgccgcggcccgcgaggcgcggcagcttgttcatcacgacgtcgtgcgcggcatcggcgagcgacgcgccgcgatacgcgatctgcgcggcaacgtcatgcgcggtcgcgagccggatgaacatctcgccggtgcccgtcgacgacaccgcgcaggtcgcatcgtccgcatagcagcctgcgccgatgatcggcgaatcgccgacacgccccggctgcttgttcgtgatgccgcccgtcgacgtcgccgccgcgatgtggccgtgccggtcgcacgcgaccgcgccgaccgtgccgtgcttgcggtccggatcgagcggctcggccggctgcggctgcgactgtgatttgccgaacgcgaacgtcgccgcgtcatggtcgagcatcgcgccggctgccgcgcgcgccttgacccactgcgcgtgacgcgcttcggtgtcgaaatagccgggctccgcgagttcgagcccctgtgcggccgcgaacgcatcggcccccgcgccggcgaacagcacgtgttcgctcgcctccatcacgcgccgcgcggcgagcaccggattgcgcacgcgcgtcgcgcagcagatcgcacccgcgccgagcgtcgcgccatccatgaccgccgcgtcgagttcgtgcttgccttcggccgtatagacggcaccgcgcccggcgttgaacaacggacagtcctcgagcatccgcaccgcgacggtgacggcgtcgagcgcgctgccgccgtcggccagcacctgctgggcggccgtcaggatcgcggtcagctcggcacggtactgacgttcggtatcggaatccatcgcatcgcgcaggatcgtgcctgcgccgccgtgaatcgcaacgatcgcgggtgaagtcatgtttttcggacggtgggaagaagggttggcggccggctgcgtcgcttgcggctgcatgagccacggcagcaggaattcggtcatctcggcggcggatttcgcggaccggtgcgtgcgcagcgcgaccgcgtcgatcagcgcctcgatcatcgtgagcacggcggcttccgacgtcgccgcgaagcgccgttcggccttgacgtacaggttcagcgacgcgatcggcgccagcggcgattgcgggccgtcggagataccgagtacgcgtgcaccgcgcgcgcgcgcgggccagttcgatcgtgtccttcacgtagcgcggaaacgcgagcgcgatcacgagatcgcgcgagtcggccgtatagagccgccgtgccgcgtgcgacgggccgccgagcagcgcgagcgactgcacgttgtcgtggcagacggacagcccgtgctccatcagcccggcgaggaacgcgctcgaccccgcgccgaggatcagcacgcgccgcgcgccgacgatcgcctcgaccgcggactcgacatcggccgcgtccagttgcgcgcgcgtgttctcgatgttcgcgacggcctggtcgaataccgcgtcgatccatgcggcaccgcgcaccccggactcctgctcctgcgcggaacgcagccgctcgaccggcccgagcgtcgcttcgaagccgcgcacgagcgccgcgcgcatcgccggatagccgtcgaaaccgagcgccttcgcgaaacggttcgcggtcgcgatcgacgcattcacggcctgcgcgagttcgtcgatgcgcatcgtcgccgcgcggaacggattcgcgagcacgaactcgcccatgcgccggtggatcggcgtcatcaacggcatcgccgacgcgatccgttcggcgatcgcgggttcgtcgtgactggcatcgtgcggagcgagaggcgtcatgcgaagggttgttgaaagaatgatggaaatgaatttacacaatcccaattacgaaaagaaataaattttcatccgggttgtgacgtcccgttccccgccccgcgatcgcccgacgcccgcacagccccgccgcacgggcctttggcatgtgatcgccgcgggtccgcacgtgcgtcgcctgcgcccgcccatggggaaaaccccgagcaagttcgttcgaatgcaatttcgcgttgaccggattcgaattcgaacataggatgttcgaaaatgatcagtcgtccgataacttaagcctccgagaacggcgaagtgttcgcttgaacgccatcattccgcgtcaaaccgggaaaactggcacccatcaagatcggacatcgtacgaataaagcgaaacaggccatcccgaacggatggtcgtcatggatcggtccggcgccgcgcgccggccctgcccgacaggagacagcagtgaagacagtcaaggcgttgcgctggtggatcatcgtgctcgtatgtctcggcacgatcctcaactacctcgcacggaattcctcgcggtgctcgccccgagctgaagcacgtgttcgcgatctcgacgcagcagtattcgtacatcgtcggcgcgttccagatcggttacacgatcatgcagcccgtgtgcggtttcatcgtcgacctgatcggcctgcgcctcgggttcgcgctgttcgcgatgctgtggtcggtggtcggcgtcgcgcacggcttcgcatcgggctggctgtcgctcggcatcctgcgcggcctcctgggcctgttcgaagccgccgcgattccgtcggggatgaaggcggttgcggaatggtttcccgatcgcgaaaaatccgtcgcggtcggctatttcaacgcgggcacgtcgctcggcgccgcgatcgcgccgccgctcgtcgtgttcctgtcgatgcggttcggctggcaggccgcgttcatggccaccggcgcgctcggtttcctgtgggccgcgctctggtacacgcaataccggtcgcccgccgaccatccgcgcatcacgccgcaggagcgcgcgctgatccgcgacggccaggcgacgatgccgcccgtgtcgaagcgccgcattcgcgacgtcgtcaccgcgcggcgcttctgggccatcgcgctgccgcgtttcttcgccgagcctgcgtggcagaccttcagcttctggattccgctgtacctcgcgaccgagcgccacatgccgctcacgcagatcgcgatcttcgcgtggatgccgtttctcgcggccgacgccggcggcatcgcgggcggctacctgtcgccgtatctcgcgaagcggttcaggctgccgctcgtgtggtcgcgcgtcgccggcgtcgcgctcggcgcggtgctgatgctcgggcccgcgatgatcgggctcgtgtcgtcgccgtacacggccatcgcgctgttctgcgtcggcggcttcgcgcaccagatgatctccgcgctcgtcaacacgctgtcggccgacgtgttcgattccgaggaagtcggcaccgcgagcggcttcgccgggatggccgcgtggatcggcgggctcggtttctcgctgctggtcggcgcgctcgccgacaagatcggctatgcgccgctgttcgcgtgcctcggcctgttcgacatcatcggcgtcacgctgctcgcggtgctgatccgcgggcagtcgaagcaggaacgcctgctcgcacggcacgcctgaccttcgcccctaactggaaccgcattcatgacttcgcttcttcatccgcccgtgttccgcgtcgccggccagcacgcgaaccgtgtgctgctcgcgtccgatacgggcgcgaccctcgagatcttcgtgctcgaggacgacatcgtgcgcgtacgcgtgctgcccgacgccacggcgcgcaacccgcgcacgtggacgatcgcgccgggcctcgacgacgtgccgctcgaagggcgcgaccgcctcgacctgagcggcttcgcgctgccctcccatacgctcctggaagacgacgacggcgtgtacatcgaaaccgcgcagatccgcctcgccgtgagccggcaaggcggccactgcacgtggtcgatgcgcggcgccgacggcgcgtggcgcgtcgcgctcgccgatcgcgcgacgcaggcgtacaacttcggctggtgggacgatcgcgcgtatcactatgtcgcgcgcgaacgcggcgacaaggtgttcggcctcggcgaacgcgcgggcgagctcgaccgcaccggcgcgcgcttcgagatgcgcaatatcgacgcgatgggctacagcgcgaagcacacggacccgctgtacaagcacatcccgttctacatcacgtggtcgccggacgcctgccagggcttcgggctgttctacgacacgctgtcggactgcgcgttcgacatgggccgcgagctcgacaactatcacggcccgtaccgctacttcgtcgccgagcatggcgatctcgactactacttcatcgcgtcgcccgacacgccgctcgcggccgcgcggcgcttcacgtggctcacgggcgccccgcgcgcaccccgaaatgggggctcggctactcgggctcgacgatgagctacaccgatgcgccggacgcgcagcagcagatgaaccagttcgtcgaacagtgcgacacgcacgacatcctgtgcgattcgttccacctgtcgtcgggctatacgtcgatcggcgcgaagcgctacgtgttcaactggaaccgcgacaagtttcccgacgcgaagggcttcgtgcagcattaccgcgaccacggcatccgcctgtgcgcgaacatcaagccgtgcctgctgcgcgaccatcccgccttcgaagacgcggcaacgcgcgggctgctgatccgctcggcgtccggcgagccggcctgggtgcagttctgggacgaggtgggcgcgtatctcgacttcacgcagccggacgcgtaccgctggtggcgcgagcaggtcacgtcggcgctgctcgaatacgggatcgagtcgacctggaacgacaacaacgaatacgagatctggtcgcccgacgcgatcgcgcacggcttcggccagccgtttcccgcgcgcgaggcgaaggtgctgcagacgatgctgatgatgcgcgcgtcgcgcgaagcgcagcgcgcgcatgcaccggcgcagcgcccgttcctcgtgtcgcgctccggcggcgccggcatgcagcgttatgtgcagacctggtccggcgacaactacacgtcgtggaaacgctgcgctacaacctgaagatgggcctcgggctcgcgctgtcgggcgtgtcgaacatcggccacgacatcggcggcttctccgggcccgcgccgtcgcccgaactgctgctgcgctgggtgcagttcggtatcttcatgccgcgcttcagcatccattcgtggaacgacgacggcaccgtcaacgaaccgtggatgtacccggagatcaccgcgcaggtcgcatcgctgatcaagcagcgctaccggctgctgccctacctctatcacctgctgtggctgtcgacgacgcgctacgagcccgtgctgcggccgaccctcgccgatttccccggtgacgcgcgctgctacgacgcatgcgacgacatgatgctcggcgacgcgctgctcgtcgcgccggtcgtcgatccgggcctgacggagcgcaccgtctacctgccgtcgggcgcgcgctggatgtgctgtgcgagcgcgcggtcgttcgacggcggcgcgagcgtaacgctgcccgccccgctcgacacgccggtgatgctgctgcgcgagggccgcgtgctgccgctgaacgtcgcggaacagcatttcggcgcacgtgccgacacgcgcggcttcgtcgtcgcgccgcgcgtcgaggacggcgtcgcgtacggcgaatgcatcgaggacgacggcgagacggaagcatggcgcgacggcgaatacgggctgtggcgcgtcgaaaccggccgcgaggcgtcgggcgtgctcggcgtgtcggtgcgctgggacggccgcccggcacgcccggccgaccgcgtcgagatcctgctgcccgcgtcggtgcaaggcgcggtcgccgtgcgcggcgcacgcgtcgaacaggatgcgcagagcggtacatggcgccgcatcgtcgtcgccttcgacaactgaagcaaacccgatcgggcgggccgttcatgcggcccgccgcccgccacagaggaggcgatcgagcctcccgcccaccttgaaaagatgaagagatccggagatcgacaatgaaagcacccgtcaaccgctatgcaatcctgattttgtcgaccgcatcgctcggcgcgaccgccgcccatgcgcagagcagcgtgacgctgtacggcgtcgtcgacgattcgctcgcgtacgtgaacaaccagcaaggccattcgaacctctacatgcgcgacggcaacctgtatgcgtcgaagttcgggctgcgcggcgacgaggatctgggcggcggcacgcatgcgatcttcgacctgcagtccggcttcaacctgaacaacggcgcgcaatccgccgccggcctgatattcaatcgccaggccttcgtcggcctgcgcaacgatcgctacggcacgatgacggccggccgccagtacacgccctacttcctgttcgtcggcccgtatgcatcgagcagctggctgaccggtgcgacgggcgcgcacccgggcgacatcgacggcctcgacacgacgatccgcgtgaacaattcggttacctatacgtcgccgaccttcgccggactgaccgcgagcgcgatgtacgcattcggcggcattgccggcgcgaccggcaagggcaacacgttcagcgccgcactgcgttatgcgaacgggccgatcggcgtcgcggccggctacctgcgcatcaacagctcgggctcgtcggcaggcttcctgaatccggcgaccgccgcgtcgggcagcttcgcggtgtccgtgctgaaccagggctacctgaccgcgaaggccgtcgagcaggtcgcggcggccggcaactacacgctcggcaacctgacgatgggcgtcaactattcgaacgtgaagtatctgcccggcaacggctccgcgttcacggatacggccgtgttcaacacctatggcgcgctcgccgcataccgcttcacgccggcattctcggtggccggcgcgttcgcgtacacgctcgcgtcgaaggcgaacggcatcgacagcgcggcccgctaccagcagtattcgctgaaggagtcgtacagcctgtcgaagcgcacgacgctctatgcgctgcaggcgtacacgcattcgagcggccggacgctcggtgcgcaaggtgccggccacgtgatcgacgcggcgccgatcgtcggcgattcgcagcagctcacgccttcgacgacgcacggccagttcgtcggcatggccggcatcgccgtcacgttctgagccatcgcggcagcgccttcggcgcgctgccctgccccgggcgacacgcattgctcggatgcctcgcgtgctgtccgggcacccgatacgcggccgccgcggggcgttttcaacgccccgtccgcacgccgcgcaaactgcacgggttttctcgatcccctcgataccttacaattcgtcaggttcaaccctcctgcataccccttcttgcagtcctgacaccgcggtacactcgacgcacgccgtatcagggtccgacgcgcgacacgcgcgccgggcggcgtcgcgcctcgttgcgcccacaactggatgccagccatgccagattcccgtccctcgccccgcacgacattcaagccgcaggtcgtcctgcccgcgctcgcagtcatcggcgctctgctcgtcgtgtgcgctgctcccaagcgaagccggcgcgctgttctccaccggccagcaatgggtcgtcgcgcgcttcgactggttctacgtgctcgccgtcaccggcttcctcgtgtttctcgtgctgatcgccgcgagcgatttcggcaacatccggctcggccccgacgatgccgaacccgaattcagcttcctgtcgtggacagcgatgctgttcgcagccggcatgggcatcggcctcatgtacttcggcgtcggcgagccgatgcagcacttcctgaagccgccgaccgtcgaccccggcacgcccgccgctgcccgcgaggcgatgctgatgaccttcttccactggggcttccacgcgtgggcgatctacgggctgatggggctcgtgctcgcgtacttcggcttccgctacaacctgccgctgacgctccgctcggggctgtatccggtgctgcgcgagcgcatcaacggctggatcggccacacggtcgacgcgttcgcgctggtcggcacggtcgccggcatcgcgacgacgctcggctacgggtgatgcagatcagcgcgggcctgcatacggtcgccggctgggatacgggcagcaatgcgtttcgcatcgggctcgtcgcgctcgtcgtgatcctcgcagggctgtcggccgcaagcggcctcgacaagggtgtgcgacggctgtccgaactgaacctgctgctcgcgttcctgctgctcgcgttcgtggccgtcacgggcccgacggcgttcctgttgcgcgcgctcggcgacaacatcggccagtacctgtcgagcctcgtcgacctgtcgttccgcacgtacgcgtatgcgtcgccgcgcgaggaaggctggttcggcggctggacgatcctctactgggcatggtgggtatcgtggtcgccgttcgtcggcatgttcatcgcacgcatctcgcgcggccgcacgatccgccagttcgtgatcggcgtgctgctcgtgccgaccgcgttcaacctcgtgtggatgaccgtgttcggcaacagcgcgatctggctcgatacgcacggcgcggccggcgcgctcgcgcagacggccaccaatgtcgatgcgctgctgttccgcttcttcgatttcctgccgctgtcgcaagggctgtcgatcgccgcgatcatgctgatcgcggtgttcttcgtcacgtccgccgattcgggcgcgttcgtgatcgaccagatcgcgacgcgcggccacgcgcactcgccagtctggcaacggctgttctgggccgcactgctcggcgtgacggccgcggtgctgctcgtcgcaggcgggctcggcgccttgcaggcgatgacgctgatcgccgcgctgccggtcgcgatcatcatgatcgcgctctgctacgggctgtggcgcgggctcgcggccgaccgcgtgcactattcgcaggacgtcgcgcccgcgacgagcttctggaccggccagcactggcgccaccgcctgacgcacatcctgcggcaaacgaccgaagccgaagcacgccagttcgtcgccgaaacggtcgagccggcgctgcgcaaagtcgccgacgagttgcgcgcgggcggcgtcgatgcgcacgtgcagcgcgacagcgacgacgccgtgcgcctgaccgtgccgaccgccgaccaccgcgatttcgtgtacggcgtgcgcgtgacggtgaaatcggcggctgcgttcctcgtgcgcgagacggccgggccggaagcggcacgggcccacgtgtacgggatcgtcacgttcttcgaggacgggcggctcggctacgacgtcgaatacctgcgcggcgacgaagtgatcgccgacgtgttgcgccagtacgaacgctacgtgtcgctcgcggccgacaagcgcacgcatctgctgagccgcgcgccggggcatgcgacggaggccgaatgaccctgcccgccgtctttgccgcgccgcggcggcctgccacggccgacggagccgcacgatgaccgggctcctgcaaagccgcgcctccgacgtcatcgcgctcggcacgctcgccgtgctctatctcggcggagccggcatcgcgctgtggcggatccgcgccgcggcgccgcgcggcaaggtctactggatcgtctgcgcggcgctgctcgccggcggcgccgtcgcgatgggcatcaacctgtcgccgatgccggacaccggagacatgccgcccgggttcgcgctcggcgtcgaagccgtcctgctcggtctcgcattggtcgccggcggttgcgcgtggctgatgctgcgcgcgcggcgacgctgacgtgcttacgtcatgcggccaggccacgtcccgcgcgaacggcaacgcgcggggcgaagcggccgcccttccccgatccgcttcctcgccgcaacgtgtcacacggacggtgcacgcgccgtcacgagccagcaagccgcgtcgaagcgcacatccgcgccgtcgacgtaaggctcgaacgcggcacgcatcgtgtcgaccacgcgccgccgcgttgcgtcgtccacttccagcagcgccagcccgaccgggcccagccgggtgatgtagtcgtccagcgcggacgcgggcagcgcgcacgccagttcgaccggctcgatcgccacgtccgcccagccgctgtccgccagcaccgacacaatccgctgccggtcgccgaagccgaactgccccggcgcgccgggccgccgtgcgggcaggttcggcagcaacggcgccgcggcccgctcggcgatcgtcatgaacggattgtctgccgcgctgcgccatgcgacgaaccgcatccgcgcatccggccgcgccgcctgccgcagattcgcgaacgcgcgaaccggatcgtcgaagaacatcacgccgaggcgcgacacgatcaggtcgacgctcgcgggctcgaacgcgtgcgtctgcacatcggcacgcacgaagcgggcgtggacgccgctgcgttcggcacgcgcctgcgcggcgtcgatcatccgggccgagatatcgatacccgtgcattgcgcatgcgcgccgagccgccgcgcgatcgcaaccgtgaccgcgcccgtgccgcagccgacgtcgagcacgctgcgcgcggacgacgtggcaaccgcctccacgagcaaccgctccaacggctcgaacatccggtcgatcagcgcctgtgtctcgacccaggcgcggcccgacgggccgttccaaagcgcggattgttcgtcattgggccgtctggtttccatcgtcgattccctttccggttcattgatcgtgcatcgcactttgctgcttcaagccggcttgaagtcaagcccccgtggccgcgacccgccgccgcaacgtcgacgcccggcccgcgtgcgaactctccgtcgcgccccgtttttcatatttcttacattcatgttgcgtatcgtcgacgactttcctacggtgcctcccatgcgacgactcctcccgcgcgccctgctcgtccgctgcgctccccttgttgctttcgccgcgctgtccgcgtgctcgaaccacatcgattcgccggacgatccggcgagtgcgtcggtcaacgtccaggccgcatgggtcgagatcggcgatacgaaccaggcgatcgcgcgcgtcatcacgaactacacccccgcgtcggccagtgatccgttgtgcccgcaactgagcgtcgacggcaagctgtcgcgcatgtccctgcgcgcgggcgccgcgaccatcgcccagcggccgaccgccagcgatccgtccgattcgaagccgtcgagcttcccggtgtccgtctgcgaggcgacgctgccggccggcgcgctggcggcgagcgtcgcgggccgcacgctgccgctgccgaaggtgcagccgcaacgcatcgcgatcatcgccgacaccggctgccgcatgaagaaggccgacaacgcatggcaggcgtgcaacgacgcgacggtctggccgctcgacacgatcgcggccagcgtcgcgaagctgtcgcccgacctggtgatgcacatcggcgactaccactaccgcgaaaacgcatgcccgccggacatcgccggctgcaaggacagcccgtggggctacggctgggatacgtggcaggccgacctgttccgcccggccgcgccgttgctcgcgaaggccccgtgggtcgtcgtgcgcggcaaccacgaggaatgcgcacgcgcgggccaaggctggttccgcttcctcgatccgcgcccgtattcggccgcgcgctcgtgcgacgatccggccaacgacagcaacgcgaactattcggaaccctatgcggtatcgctcggcggcggctcgcaggtgatcgtgttcgacaccgcgaaggtcggccgcacgccgctcaagacgaccgacgcgcagttcggcatctaccagaagcagttccagacggtcgccgcgctcgcgtcgacggccggcatgacgacgacgatcttcacgaaccaccatccgatcctcgcgttcgcgccgatcgccggcagcacgcccgcgcccggcaacctcgcgctgcagtcggtgatgtcgagcctcaacgcccaggcgtactacccgcccggcgtgcacgtggcgctgcacgggcacgtgcacgatttccaggcgatcaacttctcgtccgggcacccggcgacgatcgtgtccggcaacggcggcgacaatctcgacgtcgcgctgcccgacccgttcccggccggcctgacaccggcaccgggcgccgtgatcgagcggctgtcgcacaacaacagcttcggcttcctgatgatggaacgccgggccgccccggcgacgggctgggtcttccacgcgtattcggcggccggcaagctgctcgcgtcgtgcaaccagtcgggcaggacgctcgcctgcgacaagacggggttcatcgcgccgtgagtgaaggagttcgatgtgccggccgccacgcgcgcggccggcaaacgctgcgcacgctggccgctgccgtgctcgcgggcctgacgctcgcggcgcacgccgcgccggccgaaaccgtcctgcttcccggtgcgccgccgtcgcgagtcgtcggcacgatcggcaacggcacgccgcaggtgacgggcaagatcgatgcggcgaccgcgcgcttcgcgcccgacccgacgctcgtcgcgctcggccgccggatcttcttcgattcacggctgtccgagccgcgcggcatgtcgtgcgcgggctgccacgacccgggccgcgcgttcgcgccgacgctgtcggccgcctcg

(The sequence listing continues in the following parts.)

What is claimed is:

1. A composition comprising a cell-free supernatant produced by culturing a microbial strain comprising a DNA sequence exhibiting at least 99.5% sequence identity to SEQ ID NO. 1 and at least one of SEQ ID NOs. 2-6; and at least one excipient, diluent, or carrier.

2. The composition of claim 1, wherein the at least one excipient, diluent, or carrier comprises a surfactant, a solvent, an emulsifier, a buffer, a cryoprotectant, a salt, a microbial culture medium, a wetting agent, a bulking agent, an anti-caking agent, a thickener, a clay, a mineral, a lipid, a gum, a dye or colorant, a biological waste material, or any combination thereof.

3. The composition of claim 1, wherein the composition further comprises an effective amount of at least one additional active ingredient, wherein the additional active ingredient comprises a fertilizer, a pesticide, an herbicide, or any combination thereof.

4. A method for treating or preventing a plant disease caused by a pathogen, the method comprising applying the composition of claim 1 to a plant or a material in a bed surrounding a plant.

5. The method of claim 4, wherein the composition is applied from about 2 to about 30 days prior to exposure to the pathogen.

6. The method of claim 4, wherein the composition is applied from about 3 hours to about 48 hours after exposure to the pathogen.

7. A method for treating or preventing a plant disease caused by a pathogen, the method comprising applying the composition of claim 1 to at least one environmental component of a plant, wherein the at least one environmental component comprises leaf debris, soil, the plant's rhizosphere, or any combination thereof.

8. The method of claim 4, wherein applying the composition reduces primary inocula by at least 30% after 5 days.

9. The method of claim 4, wherein the pathogen comprises a bacterium, a fungus, an oomycete, or a virus.

10. The method of claim 9, wherein the fungus comprises *Calonectria pseudonaviculata, Alternaria* tenuissium,

*Botrytis cinerea, Collectortrichum acutatum*, Collectortrichum frutticola, Collectortrichum gleosporiodes, Collectortrichum *viniferum, Fusarium* proliferaturm, *Fusarium solani*, or *Volutella* buxi.

11. The method of claim 4, wherein the composition is applied to roots, leaves, fruits, flowers, stems, or seeds of the plant, soil, compost, mulch, leaf litter, sawdust, straw, pine straw, wood chips, gravel, plant growing medium, other material in a bed surrounding the plant, or any combination thereof.

12. The method of claim 4, wherein the plant comprises Fraser fir, *petunia, rhododendron*, annual *vinca*, bell pepper, cucumber, tomato, *hydrangea*, pansy, boxwood, geranium, or *impatiens*.

13. The method of claim 12, wherein the plant pathogen is a fungus and wherein the fungus comprises *Calonectria pseudonaviculata* and the plant comprises boxwood.

14. The method of claim 4, wherein performing the method reduces at least one symptom of the plant disease by at least 50%.

15. The method of claim 14, wherein the at least one symptom comprises leaf yellowing, leaf loss, wilting, dwarfing or hypoplasia, gall formation, mycelium or mold growth, smuts, rusts, sclerotia, tissue necrosis, cankers, blight, rot, hypertrophy, or any combination thereof.

16. The method of claim 4, wherein performing the method reduces transmission of the plant disease by at least 50%.

17. The method of claim 4, wherein the plant pathogen is a fungus and wherein performing the method lyses at least a portion of fungal conidia, causes defects in formed fungal conidia, suppresses mycelial growth, reduces survival of fungal microsclerotia, reduces sporulation, or any combination thereof.

18. The composition of claim 1, wherein the at least one excipient, diluent, or carrier comprises 0.01% polysorbate 20.

* * * * *